United States Patent
Brown et al.

(10) Patent No.: US 12,234,456 B2
(45) Date of Patent: Feb. 25, 2025

(54) COMPOSITIONS AND METHODS FOR MODULATING APOC3 EXPRESSION

(71) Applicant: Dicerna Pharmaceuticals, Inc., Lexington, MA (US)

(72) Inventors: Bob Dale Brown, Littleton, MA (US); Henryk Dudek, Belmont, MA (US); Utsav Saxena, Watertown, MA (US); Wen Han, Boston, MA (US)

(73) Assignee: Dicerna Pharmaceuticals, Inc., Lexington, MA (US)

( * ) Notice: Subject to any disclaimer, the term of this patent is extended or adjusted under 35 U.S.C. 154(b) by 5 days.

(21) Appl. No.: 18/060,881

(22) Filed: Dec. 1, 2022

(65) Prior Publication Data

US 2023/0272393 A1    Aug. 31, 2023

Related U.S. Application Data

(60) Provisional application No. 63/264,730, filed on Dec. 1, 2021.

(51) Int. Cl.
C12N 15/113    (2010.01)

(52) U.S. Cl.
CPC ........ *C12N 15/113* (2013.01); *C12N 2310/14* (2013.01); *C12N 2310/315* (2013.01); *C12N 2310/321* (2013.01); *C12N 2310/322* (2013.01); *C12N 2310/351* (2013.01)

(58) Field of Classification Search
CPC .............. C12N 15/113; C12N 2310/14; C12N 2310/315; C12N 2310/321; C12N 2310/322; C12N 2310/351; C12N 2310/346; C12N 2310/531; A61K 31/7088; A61P 1/16; A61P 3/06; A61P 3/10
See application file for complete search history.

(56) References Cited

U.S. PATENT DOCUMENTS

| | | | |
|---|---|---|---|
| 8,372,968 B2 | 2/2013 | Tuschl et al. | |
| 8,513,207 B2 | 8/2013 | Brown | |
| 8,883,996 B2 | 11/2014 | Rossi et al. | |
| 8,927,705 B2 | 1/2015 | Brown | |
| 9,012,138 B2 | 4/2015 | Tuschl et al. | |
| 9,012,621 B2 | 4/2015 | Tuschl et al. | |
| 9,193,753 B2 | 11/2015 | Tuschl et al. | |
| 2012/0184595 A1* | 7/2012 | MacDonald | |
| 2019/0000870 A1* | 1/2019 | Abrams | |

FOREIGN PATENT DOCUMENTS

| WO | WO-2010033225 A2 | 3/2010 | |
|---|---|---|---|
| WO | 2012177947 A2 | 12/2012 | |
| WO | 2014205451 A2 | 12/2014 | |
| WO | 2016081444 A1 | 5/2016 | |
| WO | 2019051402 A1 | 3/2019 | |
| WO | WO 2019075419 A1 * | 4/2019 | ........... C12N 15/113 |
| WO | 2021067744 A1 | 4/2021 | |
| WO | 2021167841 A1 | 8/2021 | |

OTHER PUBLICATIONS

Cheong, C. et al. "Solution structure of an unusually stable RNA hairpin, 5'GGAC(UUCG)GUCC". Nature, vol. 346 (Aug. 16, 1990), pp. 680-682. (Year: 1990).*
Nakano, M. et al. "Selection for thermodynamically stable DNA tetraloops using temperature gradient gel electrophoresis reveals four motifs: d(cGNNAg), d(cGNABg), d(cCNNGg), and d(gCNNGc)." Biochemistry, vol. 41 (2002), pp. 14281-14292. (Year: 2002).*
Ui-Tei, K. et al. "Functional dissection of siRNA sequence by systematic DNA substitution: modified siRNA with a DNA seed arm is a powerful tool for mammalian gene silencing with significantly reduced off-target effect." Nucleic Acids Research, vol. 36, No. 7 (2008), pp. 2136-2151 (Year: 2008).*
Jia, X. et al. "Lipid-Lowering Biotechnological Drugs: from Monoclonal Antibodies to Antisense Therapies—a Clinical Perspective". Cardiovascular Drugs and Therapy, vol. 35 (2021), pp. 1269-1279 . (Year: 2021).*
Jang, A.Y. et al. "New Trends in Dyslipidemia Treatment". Circulation Journal, vol. 85 (Jun. 2021), pp. 759-768. (Year: 2021).*
Lasemi et al., "Harnessing nucleic acid-based therapeutics for atherosclerotic cardiovascular disease: state of the art," Drug Discov Today. 2019;24(5):1116-1131.
Ruotsalainen et al., "Novel RNAi-Based Therapies for Atherosclerosis," Curr Atheroscler Rep. 2021;23(8):45.
PCT International Search Report and Written Opinion from PCT/US2022/080736, dated Jun. 16, 2023.

* cited by examiner

*Primary Examiner* — Neil P Hammell
*Assistant Examiner* — Alexandra Geraldine Dace Denito
(74) *Attorney, Agent, or Firm* — Dechert LLP; Andrea L. C. Reid; Gang Wang

(57) ABSTRACT

Oligonucleotides and compositions including the same are disclosed for inhibiting or reducing apolipoprotein C-III (APOC3) gene expression. Methods of making and using the oligonucleotides also are disclosed, particularly uses relating to treating diseases, disorders and/or conditions associated with APOC3 expression.

11 Claims, 3 Drawing Sheets

Specification includes a Sequence Listing.

COMPOSITIONS AND METHODS FOR MODULATING APOC3 EXPRESSION

CROSS REFERENCE TO RELATED APPLICATIONS

This application claims the priority of U.S. provisional application No. 63/264,730, filed Dec. 1, 2021, which is hereby incorporated by reference in its entirety.

SEQUENCE LISTING

A Sequence Listing conforming to the rules of WIPO Standard ST.26 is hereby incorporated by reference in its entirety. The Sequence Listing has been filed as an electronic document via Patent Center in ASCII format encoded as XML. The electronic document, created on Feb. 17, 2023, is entitled "400930-032US-194347_ST26.xml," and is 3,289,927 bytes in size.

TECHNICAL FIELD

The disclosure relates generally to biology and medicine, and more particularly it relates to oligonucleotide composition and their use for inhibiting or reducing apolipoprotein C-III (APOC3) gene expression, as well as their use for treating diseases, disorders and/or conditions associated with APOC3.

BACKGROUND

APOC3 is a protein encoded by APOC3, is a protein found on triglyceride-rich lipoproteins (TRLs) and high-density lipoprotein (HDL) having inhibitory activity toward lipoprotein lipase (LPL) and hepatic lipase (HL) and is a protein that delays hepatic clearance of TRLs. Human APOC3 is expressed highly in hepatocytes and in the small intestine.

Several naturally occurring gain-of-function polymorphisms have been identified in the APOC3 gene, which are postulated to be contributing factors in development of hypertriglyceridemia. These polymorphisms are strongly associated with a wide spectrum of diseases, such as non-alcoholic fatty liver disease (NAFLD), metabolic syndromes (MetS), insulin resistance, acute coronary diseases (ACD), and coronary heart diseases (CHD) resulting from hypertriglyceridemia. Several loss-of-function polymorphisms have been shown to be associated with reduced plasma triglycerides and liver fat, increased plasma concentration of HDL cholesterol and APOA1, and reduction of risks of ischemic artery and heart disease and coronary artery diseases.

Several RNA-based therapeutics are known that can inhibit or reduce APOC3 expression. For example, Intl. Patent Application Publication Nos. WO 2010/083615, WO 2012/177947, WO 2016/011123, WO 2016/081444, and WO 2019/051402, as well as CN Patent Application Publication No. 108239644, describe double-stranded (ds) RNAi constructs for inhibiting or reducing APOC3 expression, as well as methods of using the same for treating or preventing lipid metabolism conditions, diseases and/or disorders such as obesity and cardiometabolic disorders. Also, Intl. Patent Application Publication No. WO 2014/205451 describes antisense oligonucleotides for inhibiting or reducing APOC3 expression.

Despite the existence of some therapeutics directed toward APOC3, there is a need for additional therapeutics for inhibiting or reducing APOC3 expression for treating liver disease.

BRIEF SUMMARY

To address this need, the disclosure describes compositions and methods for treating a disease, disorder, and/or condition related to APOC3 expression. The disclosure is based, in part, on discovering and developing ds oligonucleotides (e.g., RNAi oligonucleotides) for selectively inhibiting and/or reducing APOC3 expression in, for example, the liver. Accordingly, target sequences within APOC3 have been identified, and RNAi oligonucleotides that bind to these target sequences and inhibit APOC3 mRNA expression have been generated. As shown herein, the RNAi oligonucleotides inhibit human and non-human primate (NHP) APOC3 expression in the liver. Without being bound by theory, the RNAi oligonucleotides herein are useful for treating a disease, disorder or condition associated with APOC3 expression (e.g., hypertriglyceridemia or another dyslipidemia). In general, the RNAi oligonucleotides herein are useful for treating a disease, disorder, or condition associated with aberrant APOC3 expression (e.g., APOC3 gain-of-function polymorphisms). In particular, the RNAi oligonucleotides herein are useful for treating a disease, disorder, or condition associated with mutant APOC3 expression.

Accordingly, the disclosure describes RNAi oligonucleotides for reducing or inhibiting APOC3 expression that include a sense strand and/or an antisense strand, where the sense strand has a sequence as set forth in Table 2, and where the antisense strand has a sequence as set forth in Table 2.

In some embodiments, the sense strand has a sequence as set forth in Table 2 (e.g., any one of the odd numbers of SEQ ID NOs:9 to 170), especially any one of SEQ ID NOs:37, 43, 45, 87, 89, 99, 101, and 105.

In some embodiments, the antisense strand having a sequence as set forth in Table 2 (e.g., any one of the even numbers of SEQ ID NOs:9 to 170), especially any one of SEQ ID NOs:38, 44, 46, 88, 90, 100, 102, and 106.

Alternatively, the disclosure describes RNAi oligonucleotides for reducing or inhibiting APOC3 expression that include a sense strand and/or an antisense strand, where the sense strand has a sequence as set forth in Table 3, and where the antisense strand has a sequence as set forth in Table 3.

In some embodiments, the sense strand has a sequence as set forth in Table 3 (e.g., any one of the odd numbers of SEQ ID NOs:171 to 332), especially any one of SEQ ID NOs: 199, 205, 207, 249, 251, 261, 263, and 267.

In some embodiments, the antisense strand has a sequence as set forth in Table 3 (e.g., any one of the even numbers of SEQ ID NOs:171 to 332), especially any one of SEQ ID NOs:200, 206, 208, 250, 252, 262, 264, and 268.

Alternatively, RNAi oligonucleotides are described for reducing or inhibiting APOC3 expression that include a sense strand and an antisense strand, where the sense and antisense strands form a duplex region, and where the antisense strand has a region of complementarity to a APOC3 mRNA target sequence of any one of SEQ ID NOs:334 to 341.

In any of the embodiments above, the sense strand is from about 15 nucleotides to about 50 nucleotides in length. In some embodiments, the sense strand is from about 20 nucleotides to about 40 nucleotides in length. In some embodiments, the sense strand is 36 nucleotides in length.

In any of the embodiments above, the antisense strand is from about 15 nucleotides to about 30 nucleotides in length. In some embodiments, the antisense strand is from about 20 nucleotides to about 25 nucleotides. In some embodiments, the antisense strand is 22 nucleotides in length.

In any of the embodiments above, the duplex region is from about 19 nucleotides in length to about 21 nucleotides in length. In certain embodiment, the duplex region is 20 nucleotides in length.

In any of the embodiments above, the region of complementarity is at least 15 contiguous nucleotides in length. In some embodiments, the region of complementarity is from about 19 contiguous nucleotides in length to about 21 contiguous nucleotides in length. In other embodiments, the region of complementarity is 19 contiguous nucleotides in length, 20 contiguous nucleotides in length, or 21 contiguous nucleotides in length.

In any of the embodiments above, the RNAi oligonucleotides include on the sense strand a 3' end a stem-loop set forth as: S1-L-S2, where S1 is complementary to S2, and where L forms a loop between S1 and S2 of about 3 to about 5 nucleotides in length.

In any of the embodiments above, the antisense strand, the sense strand, or both have an overhang sequence. In some embodiments, the antisense strand includes a 3'-overhang of 1 or more nucleotides in length. In other embodiments, the 3'-overhang sequence is 2 nucleotides in length such as, for example, GG.

Oligonucleotides also are described that include an antisense strand and a sense strand, where the antisense strand can be from about 21 nucleotides to about 27 nucleotides in length and has a region of complementarity to APOC3, wherein the sense strand includes a stem-loop at its 3' end set forth as: S1-L-S2, wherein S1 is complementary to S2, wherein L forms a loop between S1 and S2 from about 3 nucleotides to about 5 nucleotides in length, and wherein the antisense strand and the sense strand form a duplex structure of at least about 19 nucleotides in length but are not covalently linked.

In some embodiments, the loop L is a triloop (triL) or a tetraloop (L). In some embodiments, L is a tetraloop of 4 nucleotides in length. In other embodiments, L includes a sequence 5'-GAAA-3'.

In some embodiments, S1 and S2 are 1-10 nucleotides in length and have the same length. In other embodiments, S1 and S2 are 1 nucleotide, 2 nucleotides, 3 nucleotides, 4 nucleotides, 5 nucleotides, 6 nucleotides, 7 nucleotides, 8 nucleotides, 9 nucleotides, or 10 nucleotides in length. In other embodiments, S1 and S2 are 6 nucleotides in length. In certain embodiments, the stem-loop comprises the sequence 5'-GCAGCCGAAAGGCUGC-3' (SEQ ID NO:333).

In some embodiments, the sense strand is 25 nucleotides in length and the antisense strand is 27 nucleotides in length. In other embodiments, the sense strand is 36 nucleotides in length and the antisense strand is 22 nucleotides in length.

In the embodiments above, the duplex region includes a 3'-overhang sequence on the antisense strand. In some embodiments, the 3'-overhang sequence on the antisense strand is 2 nucleotides in length.

In any of the embodiments above, at least one nucleotide in an oligonucleotide is a modified nucleotide. In some embodiments, all nucleotides in the oligonucleotide are modified except for nucleotides in the stem-loop (i.e., S1-L-S2). In other embodiments, all nucleotides in the oligonucleotide are modified except for nucleotides in the loop (i.e., L).

In some embodiments, the modified nucleotide includes a 2'-modification such as, for example, 2'-aminoethyl (EA), 2'-fluoro (2'-F), 2'-O-methyl (2'-OMe), 2'-O-methoxyethyl (2'-MOE) and 2'-deoxy-2'-fluoro-β-arabinonucleic acid (2'-FANA). In certain embodiments, all nucleotides in an oligonucleotide include a 2'-modification such as, for example, 2'-F or 2'-OMe.

In any of the embodiments above, at least one nucleotide in an oligonucleotide includes a modified internucleotide linkage. In some embodiments, the modified internucleotide linkage is a phosphorothioate linkage.

In any of the embodiments above, a 4'-carbon of a sugar of a 5'-nucleotide of the antisense strand includes a phosphate analog such as, for example, an oxymethylphosphonate, vinylphosphonate or malonyl phosphonate. Alternatively, or optionally, the phosphate analog is a 4'-phosphate analog including 5'-methoxyphosphonate-4'-oxy.

In any of the embodiments above, at least one nucleotide of an oligonucleotide can be conjugated to one or more targeting ligands such as, for example, an amino sugar, carbohydrate, cholesterol, lipid, or polypeptide. In some embodiments, the targeting ligand is a N-acetylgalactosamine (GalNAc) moiety. In other embodiments, the GalNAc moiety is a monovalent GalNAc moiety, a bivalent GalNAc moiety, a trivalent GalNAc moiety, or a tetravalent GalNAc moiety.

In some embodiments, the targeting ligands are conjugated to one or more nucleotides of L of the stem loop. In certain embodiments, up to 4 nucleotides of L of the stem-loop are each conjugated to a monovalent GalNAc moiety.

In certain embodiments, one or more nucleotides at positions 8, 9, 10, or 11 of the sense strand are modified with a 2'-F. In other embodiments, the sugar moiety at each nucleotide at positions 1 to 7, 12 to 27 and 31 to 36 in the sense strand is modified with a 2'-OMe. In certain embodiments, nucleotides at positions 8 to 11 of the sense strand are modified with a 2'-F, and positions 1 to 7, 12 to 27 and 31 to 36 are modified with a 2'-OMe.

In certain other embodiments, the sense strand includes a 2'-F modified nucleotide at positions 8 to 11, a 2'-OMe modified nucleotide at positions 1 to 7, 12 to 27 and 31 to 36, a GalNAc-conjugated nucleotide at position 28, 29 and 30, and a phosphorothioate linkage between positions 1 and 2.

In certain other embodiments, one or more nucleotides at positions 2 to 5, 7, 10 and 14 of the antisense strand are modified with 2'-F, and one or more nucleotides at positions 1, 6, 8-9, 11-13 and 15-22 modified with a 2'-OMe. In other embodiments, the antisense strand includes a 2'-F-modified nucleotide at positions 2 to 5, 7, 10 and 14, and a 2'-OMe-modified nucleotide at positions 1, 6, 8 to 9, 11 to 13 and 15 to 22.

In certain embodiments, the antisense strand includes a 2'-F modified nucleotide at positions 2 to 5, 7, 10 and 14, a 2'-OMe at positions 1, 6, 8 to 9, 11 to 13 and 15 to 22, and a phosphorothioate linkage between positions 1 and 2, positions 2 and 3, positions 3 and 4, positions 20 and 21, and positions 21 and 22.

In certain embodiments, the oligonucleotides have a modification pattern as shown in FIG. 1A, 1B or 1C.

FIG. TA depicts modification pattern 1, wherein the modification pattern of each strand is illustrated below:

Sense Strand:
5' mX-S-mX-fX-mX-mX-mX-mX-fX-fX-fX-mX-fX-
fX-mX-mX-mX-fX-mX-mX-mX-mX-mX-mX-mX-mX-
[X-GalNAc]-[X-GalNAc]-[X-GalNAc]-[X-GalNAc]-
mX-mX-mX-mX-mX-mX3'

Hybridized to:

Antisense Strand:
5' [MePhosphonate-4O-mX]-S-fX-S-fX-S-mX-fX-
mX-fX-fX-mX-fX-mX-fX-mX-fX-mX-fX-mX-mX-fX-
mX-S-mX-S-mX3';

or represented as follows:

Sense Strand:
5' [mXs][mX][X][mX][mX][mX][mX][X][fX][fX]
[mX][fX][fX][mX][mX][mX][X][mX][mX][mX][mX]
[mX][mX][mX][mX][mX][X-GalNAc][X-GalNAc]
[X-GalNAc][X-GalNAc][mX][mX][mX][mX][mX]
[mX]3'

Hybridized to:

Antisense Strand:
5' [MePhosphonate-4O-mXs][fXs][fXs][mX]
[X][mX][fX][fX][mX][fX][mX][X][mX][X][mX]
[X][mX][mX][X][mXs][mXs][mX]3'.

FIG. 1B depicts modification pattern 2, wherein the modification pattern of each strand is illustrated below:

Sense Strand:
5' mX-S-mX-mX-mX-mX-mX-mX-
fX-fX-fX-fX-mX-mX-mX-mX-mX-mX-mX-mX-mX-
mX-mX-mX-mX-mX-mX-mX-[X-GalNAc]-
[X-GalNAc]-[X-GalNAc]-mX-mX-mX-mX-mX-mX3'

Hybridized to:

Antisense Strand:
5' [MePhosphonate-4O-mX]-S-fX-S-fX-S-fX-
fX-mX-fX-mX-mX-fX-mX-mX-mX-fX-mX-mX-mX-
mX-mX-mX-S-mX-S-mX3';

or represented as follows:

Sense Strand:
5' [mXs][mX][mX][mX][mX][mX][mX][fX][fX]
[fX][fX][mX][mX][mX][mX][mX][mX][mX][mX]
[mX][mX][mX][mX][mX][mX][mX][X-GalNAc]
[X-GalNAc][X-GalNAc][mX][mX][mX][mX][mX]
[mX]3'

Hybridized to:

Antisense Strand:
5' [MePhosphonate-4O-mXs][fXs][fXs][fX][X]
[mX][X][mX][mX][fX][mX][mX][mX][fX][mX][mX]
[mX][mX][mX][mXs][mXs][mX]3'.

FIG. 1C depicts modification pattern 3, wherein the modification pattern of each strand is illustrated below:

Sense Strand:
5' mX-S-mX-fX-mX-fX-mX-mX-fX-fX-fX-fX-mX-
fX-mX-fX-mX-fX-mX-mX-mX-mX-mX-mX-mX3'

Hybridized to:

Antisense Strand:
5' [MePhosphonate-4O-mX]-S-fX-S-fX-S-mX-
fX-mX-fX-mX-mX-fX-mX-fX-mX-fX-mX-fX-mX-
fX-mX-S-mX-S-mX 3';

or represented as follows:

Sense Strand:
[mX][mX][X][mX][mX][mX][mX][mX][mX][mX]
[mX][mX][X-GalNAc][X-GalNAc][X-GalNAc]
[X-GalNAc][mX][mX][mX][mX][mX][mX]3'

Hybridized to:

Antisense Strand:
5' [MePhosphonate-4O-mXs][fXs][fXs][mX]
[fX][mX][X][mX][mX][X][mX][X][mX][X][mX]
[X][fX][mX][fX][mXs][mXs][mX]3'.

Modification key for the modification patterns 1-3 above:

| Symbol | Modification/linkage |
|---|---|
| Key 1 | |
| mX | 2'-O-methyl modified nucleotide |
| fX | 2'-fluoro modified nucleotide |
| -S- | phosphorothioate linkage |
| — | phosphodiester linkage |
| [MePhosphonate-4O-mX] | 5'-methoxyphosphonate-4'-oxy modified nucleotide |
| X-GalNAc | ademX-GalNAc or prgX-peg-GalNAc |

| Symbol | Modification/linkage |
|---|---|
| | Key 2 |
| [mXs] | 2'-O-methyl modified nucleotide with a phosphorothioate linkage to the neighboring nucleotide |
| [fXs] | 2'-fluoro modified nucleotide with a phosphorothioate linkage to the neighboring nucleotide |
| [mX] | 2'-O-methyl modified nucleotide with phosphodiester linkages to neighboring nucleotides |
| [fX] | 2'-fluoro modified nucleotide with phosphodiester linkages to neighboring nucleotides |

In any of the embodiments above, the oligonucleotide is a RNAi oligonucleotide. In some embodiments, the RNAi oligonucleotide includes a sense strand having a nucleotide sequence as set forth in Table 2, especially any one of SEQ ID NOs:37, 43, 45, 87, 89, 99, 101, and 105. In certain embodiments, the RNAi oligonucleotide includes a sense strand having a nucleotide sequence as set forth in Table 3, especially any one of SEQ ID NOs:199, 205, 207, 249, 251, 261, 263, and 267. In some embodiments, the RNAi oligonucleotide includes an antisense strand having a nucleotide sequence as set for the in Table 2, especially any one of SEQ ID NOs:38, 44, 46, 88, 90, 100, 102, and 106. In certain embodiments, the RNAi oligonucleotide includes an antisense strand having a nucleotide sequence as set forth the in Table 3, especially any one of SEQ ID NOs:200, 206, 208, 250, 252, 262, 264, and 268.

In certain embodiments, the RNAi oligonucleotide includes a sense strand having a nucleotide sequence of any one of SEQ ID NOs:37, 43, 45, 87, 89, 99, 101 and 105, and an antisense strand having a nucleotide sequence of any one of SEQ ID NOs:38, 44, 46, 88, 90, 100, 102 and 106.

In certain embodiments, the RNAi oligonucleotide includes a sense strand having a nucleotide sequence of any one of SEQ ID NOs:37, 89 and 101, and an antisense strand having a nucleotide sequence of any one of SEQ ID NOs:38, 90 and 102.

In certain other embodiments, the sense strand, and the antisense strand of the RNAi oligonucleotide, respectively, are selected from:
 (a) SEQ ID NOs:37 and 38,
 (b) SEQ ID NOs:43 and 44,
 (c) SEQ ID NOs:45 and 46,
 (d) SEQ ID NOs:87 and 88,
 (e) SEQ ID NOs:89 and 90,
 (f) SEQ ID NOs:99 and 100,
 (g) SEQ ID NOs:101 and 102, and
 (h) SEQ ID NOs:105 and 106.

In certain embodiments, the RNAi oligonucleotide includes a sense strand having a nucleotide sequence of any one of SEQ ID NOs:199, 205, 207, 249, 251, 261, 263, and 267, and an antisense strand having a nucleotide sequence of any one of SEQ ID NOs:200, 206, 208, 250, 252, 262, 264, and 268.

In certain embodiments, the RNAi oligonucleotide includes a sense strand having a nucleotide sequence of any one of SEQ ID NOs:199, 251 and 263, and an antisense strand having a nucleotide sequence of any one of SEQ ID NOs:200, 252 and 264.

In certain other embodiments, the sense strand, and the antisense strand of the RNAi oligonucleotide, respectively, are selected from:
 (a') SEQ ID NOs:199 and 200,
 (b') SEQ ID NOs:205 and 206,
 (c') SEQ ID NOs:207 and 208,
 (d') SEQ ID NOs:249 and 250,
 (e') SEQ ID NOs:251 and 252,
 (f') SEQ ID NOs:261 and 262,
 (g') SEQ ID NOs:263 and 264, and
 (h') SEQ ID NOs:267 and 268.

Oligonucleotides also are described for inhibiting or reducing APOC3 expression that include a sense strand and an antisense strand, where the sense strand and the antisense strand form a duplex region, where all nucleotides of the sense strand and the antisense strand include a modification of a base, a sugar and/or an internucleotide linkage, where the antisense strand includes a region of complementarity to a APOC3 mRNA target sequence of one of SEQ ID NOs:334 to 341, and where the region of complementarity is at least about 15 contiguous nucleotides in length.

In other aspects, pharmaceutical compositions are described that include at least one oligonucleotide herein, or a pharmaceutically acceptable salt thereof, and a pharmaceutically acceptable carrier, delivery agent or excipient. In some embodiments, the pharmaceutical compositions include an additional therapeutic agent such as, for example, a lipid-lowering agent, an antidiabetic agent, or anti-obesity agent.

In other aspects, methods are described for reducing APOC3 expression in a cell, a population of cells, a tissue, an organ, or an individual that include at least a step of administering/contacting the cell, the population of cells, the tissue, the organ, or the individual with an oligonucleotide herein or a pharmaceutical composition herein. In some embodiments, reducing APOC3 expression includes reducing an amount or level of APOC3 mRNA, an amount or level of APOC3 protein, or both in the cell, the population of cells, the tissue, the organ, or the individual. In some embodiments, the cell, the cell population, the tissue, the organ, or the individual has a disease, disorder, or condition associated with APOC3 expression. In certain embodiments, the disease, disorder, or condition associated with APOC3 expression is hypertriglyceridemia, high non-HDL cholesterol, liver steatosis, insulin resistance or even atherosclerotic cardiovascular disease (ASCVD).

In other aspects, methods are described for treating an individual having or suspected of having a disease, disorder or condition associated with APOC3 expression. The methods include at least a step of administering to an individual in need thereof an effective amount of an oligonucleotide herein or a pharmaceutical composition herein. In some embodiments, the disease, disorder, or condition associated with APOC3 expression is hypertriglyceridemia, high non-HDL cholesterol, liver steatosis, insulin resistance or even ASCVD. In some embodiments, the oligonucleotide or pharmaceutical composition is administered daily, weekly, monthly, quarterly, yearly via subcutaneous (SQ) administration, especially monthly or quarterly.

In some embodiments, the individual has NAFLD, liver steatosis, non-alcoholic steatohepatitis (NASH), alcoholic hepatitis (AH), alcoholic liver disease (ALD), cholangiocarcinoma (CCA), cirrhosis, hepatic fibrosis, hepatic inflammation, hepatocellular carcinoma (HCC), primary sclerosing cholangitis (PSC), hyperlipidemia, diabetes, and/or obesity.

In any of the embodiments above, the methods may comprise additional steps such as measuring or obtaining genotype information, APOC3 expression, APOC3 protein levels, the individual's weight and/or blood glucose and/or cholesterol and/or LPL and/or TG and then comparing such obtained values to one or more baseline values or previously obtained values to assess the effectiveness of contacting or administering. In some embodiments, the additional step comprises confirming that the individual has an APOC3 gain-of-function polymorphism. In some embodiments, the additional step comprises confirming that the individual has a single-nucleotide polymorphism (SNP) of rs5128, rs2854116, rs2854117, rs2070666, or mutation of 1100C>T, 2845T>G or Gln38Lys.

In any of the embodiments above, the methods can include administering the RNAi oligonucleotide or pharmaceutical composition simultaneously, separately, or sequentially with a second composition or a second therapeutic agent. In some embodiments, the second composition or a second therapeutic agent is a APOC3 antibody or fragment thereof, a lipid-lowering agent, an antidiabetic agent or anti-obesity agent. In some embodiments, the second composition or second therapeutic agent is administered with a frequency same as the RNAi oligonucleotide (i.e., every other day, twice a week, or even weekly). In other embodiments, the second composition or second therapeutic agent is administered with a frequency distinct from the RNAi oligonucleotide. Likewise, in other embodiments, the second composition or second therapeutic agent is administered via the same route as the RNAi oligonucleotide (e.g., SQ). In still other embodiments, the second composition or second therapeutic agent is administered via a route that differs from the RNAi oligonucleotide).

In other aspects, uses are described for the RNAi oligonucleotides herein for treating a disease, disorder or condition associated with APOC3 expression, which optionally are administered simultaneously, separately, or sequentially (i.e., in combination) with a second composition or second therapeutic agent.

In other aspects, uses are described for the RNAi oligonucleotides herein in manufacturing a medicament for treating a disease, disorder, or condition associated with APOC3 expression, where the medicament optionally further includes a second composition or second therapeutic agent.

In other aspects, kits are described that include at least one oligonucleotide herein, an optional pharmaceutically acceptable carrier, and a package insert having instructions for administering the same to an individual having a disease, disorder, or condition associated with APOC3 expression.

An advantage of the oligonucleotides and compositions herein is that suppressed APOC3 expression exerts a beneficial effect on the entire spectrum of dyslipidemia.

BRIEF DESCRIPTION OF THE DRAWINGS

The advantages, effects, features, and objects other than those set forth above will become more readily apparent when consideration is given to the detailed description below. Such detailed description refers to the following drawing(s), where.

DETAILED DESCRIPTION

Overview

Figure 1A:
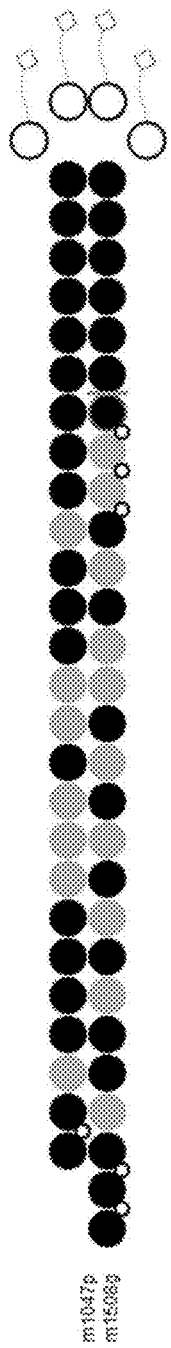
FIGS. 1A-IC disclose schematics depicting the structure and chemical modification pattern for 3 generic GalNAc-conjugated APOC3 oligonucleotides (M1, M2 and M3, respectively).
Figure 1A:
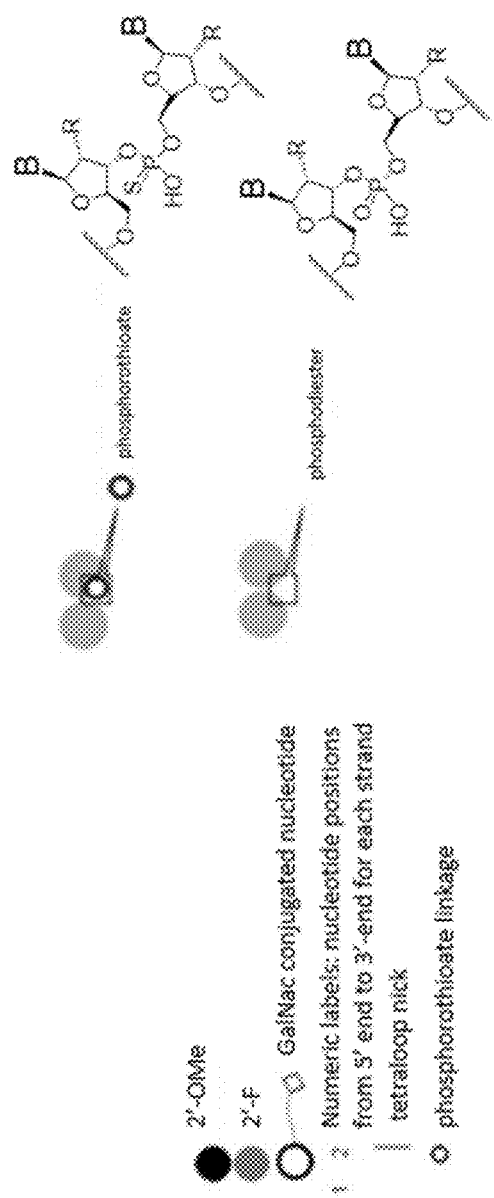

Dyslipidemia refers to unhealthy levels of one or more kinds of lipid (fat) in blood. There are three main types of lipids: high-density lipoprotein (HDL), low-density lipoprotein (LDL), and TGs. Dyslipidemia is divided up into primary and secondary types. Primary dyslipidemia is inherited, whereas secondary dyslipidemia is an acquired condition (i.e., develops from other causes such as, for example, obesity or diabetes).

RNA interference (RNAi) is a process of introducing exogeneous RNA into a cell leading to specific degradation of the mRNA encoding the targeted protein with a resultant decrease in target gene expression.

In humans, APOC3 is 99 amino acids in length (residues 1-20, however, are a signal peptide that is subsequently cleaved) with a predicted molecular weight of 8.8 kDa. Exemplary nucleic acid sequences for APOC3 can found in GenBank Reference Sequence Number NM_000040 (human), GenBank Reference Sequence Number NM_001289755 (mouse), GenBank Reference Sequence Number NM_001271053 (rat), GenBank Reference Sequence Number XM_005579730 (NHP), GenBank Reference Sequence Number XM_001090312 (NHP), GenBank Reference Sequence Number XM_008020977 (NHP), and GenBank Reference Sequence Number XM_035264642 (NHP). One of skill in the art, however, understands that additional examples of APOC3 nucleic acid sequences are readily available using publicly available databases such as, for example, GenBank and UniProt.

Definitions

As used herein, "about" means within a statistically meaningful range of a value or values such as, for example, a stated concentration, length, molecular weight, pH, sequence similarity, time frame, temperature, volume, etc. Such a value or range can be within an order of magnitude typically within 20%, more typically within 10%, and even more typically within 5% of a given value or range. The allowable variation encompassed by "about" will depend upon the system under study, and can be readily appreciated by one of skill in the art.

As used herein, "administer," "administering," "administration" and the like refers to providing a substance (e.g., an oligonucleotide herein or a composition herein) to an individual in a manner that is pharmacologically useful (e.g., to treat a disease, disorder, or condition in the individual).

As used herein, "antisense strand" means an oligonucleotide herein that is complimentary to a region of a target sequence. Likewise, and as used herein, "sense strand" means an oligonucleotide herein that is complimentary to a region of an antisense strand.

As used herein, "APOC3" means the apolipoprotein C-III gene, which encodes a very low-density lipoprotein (VLDL) protein (APOC3) that inhibits lipoprotein lipase and hepatic lipase.

As used herein, "asialoglycoprotein receptor" or "ASGPR" means a bipartite C-type lectin formed by a major 48 kDa subunit (ASGPR-1) and minor 40 kDa subunit (ASGPR-2). ASGPR is primarily expressed on the sinusoidal surface of hepatocyte cells and has a major role in binding, internalizing and subsequent clearing of circulating glycoproteins that contain terminal galactose or GalNAc residues (asialoglycoproteins).

As used herein, "attenuate," "attenuating," "attenuation" and the like refers to reducing or effectively halting. As a non-limiting example, one or more of the treatments herein may reduce or effectively halt the onset or progression of AH, ACD, ALD, CCA, CHD, MetS, PSC, cirrhosis, hepatic fibrosis, hepatic inflammation, HCC, NAFLD, and NASH, as well as related diseases, disorders, and conditions in an individual such as, for example, hyperlipidemia, diabetes and/or obesity. This attenuation may be exemplified by, for example, a decrease in one or more aspects (e.g., symptoms, tissue characteristics, and cellular, inflammatory, or immunological activity, etc.) of AH, ACD, ALD, CCA, CHD, MetS, PSC, cirrhosis, hepatic fibrosis, hepatic inflammation, HCC, NAFLD, and NASH, as well as related diseases, disorders, and conditions in an individual such as, for example, hyperlipidemia, diabetes and/or obesity; no detectable progression (worsening) of one or more aspects of AH, ACD, ALD, CCA, CHD, MetS, PSC, cirrhosis, hepatic fibrosis, hepatic inflammation, HCC, NAFLD, and NASH, as well as related diseases, disorders, and conditions in an individual such as, for example, hyperlipidemia, diabetes and/or obesity; or no detectable aspects of AH, ACD, ALD, CCA, CHD, MetS, PSC, cirrhosis, hepatic fibrosis, hepatic inflammation, HCC, NAFLD, and NASH, as well as related diseases, disorders, and conditions in an individual such as, for example, hyperlipidemia, diabetes and/or obesity in an individual when they might otherwise be expected.

As used herein, "attenuate," "attenuating," "attenuation" and the like means reducing or effectively halting. As a non-limiting example, one or more of the treatments herein may reduce or effectively halt the onset or progression of dyslipidemia/hypertriglyceridemia/hyperlipidemia in an individual. This attenuation may be exemplified by, for example, a decrease in one or more aspects (e.g., symptoms, tissue characteristics, and cellular, inflammatory, or immunological activity, etc.) of AH, ACD, ALD, CCA, CHD, MetS, PSC, cirrhosis, hepatic fibrosis, hepatic inflammation, HCC, NAFLD, and NASH, as well as related diseases, disorders, and conditions in an individual such as, for example, hyperlipidemia, diabetes and/or obesity in an individual when they might otherwise be expected.

As used herein, "complementary" means a structural relationship between two nucleotides (e.g., on two opposing nucleic acids or on opposing regions of a single nucleic acid strand) that permits the two nucleotides to form base pairs with one another. For example, a purine nucleotide of one nucleic acid that is complementary to a pyrimidine nucleotide of an opposing nucleic acid may base pair together by forming hydrogen bonds with one another. Complementary nucleotides can base pair in the Watson-Crick manner or in any other manner that allows for the formation of stable duplexes. Likewise, two nucleic acids may have regions of multiple nucleotides that are complementary with each other to form regions of complementarity, as described herein.

As used herein, "contact," "contacting" and the like means directly or indirectly introducing or delivering the RNAi into, for example, a cell by facilitating or effecting uptake or absorption into the cell.

As used herein, "deoxyribonucleotide" means a nucleotide having a hydrogen in place of a hydroxyl at the 2' position of its pentose sugar when compared with a ribonucleotide. A modified deoxyribonucleotide has one or more modifications substitutions of atoms other than at the 2' position, including modifications or substitutions in or of the nucleobase, sugar, or phosphate group.

As used herein, "double-stranded oligonucleotide" or "ds oligonucleotide" means an oligonucleotide that is substantially in a duplex form. The complementary base-pairing of duplex region(s) of a ds oligonucleotide can be formed between antiparallel sequences of nucleotides of covalently separate nucleic acid strands. Likewise, complementary base-pairing of duplex region(s) of a ds oligonucleotide can be formed between antiparallel sequences of nucleotides of nucleic acid strands that are covalently linked. Moreover, complementary base-pairing of duplex region(s) of a ds oligonucleotide can be formed from single nucleic acid strand that is folded (e.g., via a hairpin) to provide complementary antiparallel sequences of nucleotides that base pair together. A ds oligonucleotide can include two covalently separate nucleic acid strands that are fully duplexed with one another. However, a ds oligonucleotide can include two covalently separate nucleic acid strands that are partially duplexed (e.g., having overhangs at one or both ends). A ds oligonucleotide can include an antiparallel sequence of nucleotides that are partially complementary, and thus, may have one or more mismatches, which may include internal mismatches or end mismatches.

As used herein, "duplex," in reference to nucleic acids (e.g., oligonucleotides), means a structure formed through complementary base pairing of two antiparallel sequences of nucleotides.

As used herein, "excipient" means a non-therapeutic agent that may be included in a composition herein, for example, to provide or contribute to a desired consistency or stabilizing effect.

As used herein, "hepatocyte" or "hepatocytes" means cells of the parenchymal tissues of the liver. These cells make up about 70%-85% of the liver's mass and manufacture serum albumin, fibronectin (FBN) and the prothrombin group of clotting factors (except for Factors 3 and 4). Markers for hepatocyte lineage cells include, but are not limited to, transthyretin (Ttr), glutamine synthetase (Glul), hepatocyte nuclear factor 1a (Hnf1a) and hepatocyte nuclear factor 4a (Hnf4a). Markers for mature hepatocytes may include, but are not limited to, cytochrome P450 (Cyp3a11), fumarylacetoacetate hydrolase (Fah), glucose 6-phosphate (G6p), albumin (Alb) and OC2-2F8. See, e.g., Huch et al. (2013) NATURE 494:247-50.

As used herein, a "hepatotoxic agent" means a chemical compound, virus or other substance that is itself toxic to the liver or can be processed to form a metabolite that is toxic to the liver. Hepatotoxic agents may include, but are not limited to, carbon tetrachloride ($CCl_4$), acetaminophen (paracetamol), vinyl chloride, arsenic, chloroform, nonsteroidal anti-inflammatory drugs (such as aspirin and phenylbutazone).

As used herein, "labile linker" means a linker that can be cleaved (e.g., by acidic pH). Likewise, "fairly stable linker" means a linker that cannot be cleaved.

As used herein, "liver inflammation" or "hepatitis" means a physical condition in which the liver becomes swollen, dysfunctional and/or painful, especially because of injury or infection, as may be caused by exposure to a hepatotoxic agent. Symptoms may include jaundice, fatigue, weakness, nausea, vomiting, appetite reduction and weight loss. Liver inflammation, if left untreated, may progress to fibrosis, cirrhosis, liver failure or liver cancer.

As used herein, "liver fibrosis," "hepatic fibrosis" or "fibrosis of the liver" refers to an excessive accumulation in the liver of extracellular matrix proteins, which could include collagens (I, III, and IV), FBN, undulin, elastin, laminin, hyaluronan, and proteoglycans resulting from inflammation and liver cell death. Liver fibrosis, if left untreated, may progress to cirrhosis, liver failure or liver cancer.

As used herein, "loop" means an unpaired region of a nucleic acid (e.g., oligonucleotide) that is flanked by two antiparallel regions of the nucleic acid that are sufficiently complementary to one another, such that under appropriate hybridization conditions (e.g., in a phosphate buffer, in a cells), the two antiparallel regions, which flank the unpaired region, hybridize to form a duplex (referred to as a "stem").

As used herein, "modified internucleotide linkage" means an internucleotide linkage having one or more chemical modifications when compared with a reference internucleotide linkage having a phosphodiester bond. A modified nucleotide can be a non-naturally occurring linkage. Typically, a modified internucleotide linkage confers one or more desirable properties to a nucleic acid in which the modified internucleotide linkage is present. For example, a modified nucleotide may improve thermal stability, resistance to degradation, nuclease resistance, solubility, bioavailability, bioactivity, reduced immunogenicity, etc.

As used herein, "modified nucleotide" refers to a nucleotide having one or more chemical modifications when compared with a corresponding reference nucleotide selected from: adenine ribonucleotide, guanine ribonucleotide, cytosine ribonucleotide, uracil ribonucleotide, adenine deoxyribonucleotide, guanine deoxyribonucleotide, cytosine deoxyribonucleotide, and thymidine deoxyribonucleotide. A modified nucleotide can be anon-naturally occurring nucleotide. A modified nucleotide can have, for example, one or more chemical modification in its sugar, nucleobase, and/or phosphate group. Additionally, or alternatively, a modified nucleotide can have one or more chemical moieties conjugated to a corresponding reference nucleotide. Typically, a modified nucleotide confers one or more desirable properties to a nucleic acid in which the modified nucleotide is present. For example, a modified nucleotide may improve thermal stability, resistance to degradation, nuclease resistance, solubility, bioavailability, bioactivity, reduced immunogenicity, etc.

As used herein, "nicked tetraloop structure" mean a structure of a RNAi oligonucleotide that is characterized by separate sense (passenger) and antisense (guide) strands, in which the sense strand has a region of complementarity with the antisense strand, and in which at least one of the strands, generally the sense strand, has a tetraloop configured to stabilize an adjacent stem region formed within the at least one strand.

As used herein, "nucleotide" means an organic molecule having a nucleoside (a nucleobase such as, for example, adenine, cytosine, guanine, thymine, or uracil; and a pentose sugar such as, for example, ribose or 2'-deoxyribose; and a phosphate group, which can serve as a monomeric unit of nucleic acid polymers such as deoxyribonucleic acid (DNA) and ribonucleic acid (RNA).

As used herein, "oligonucleotide" means a short nucleic acid molecule (e.g., less than about 100 nucleotides in length). An oligonucleotide may be single-stranded (ss) or ds. An oligonucleotide may or may not have duplex regions. As a set of non-limiting examples, an oligonucleotide may be, but is not limited to, a small interfering RNA (siRNA), microRNA (miRNA), short hairpin RNA (shRNA), dicer substrate interfering RNA (dsiRNA), antisense oligonucleotide (ASO), short siRNA, or ss siRNA. Typically, a ds oligonucleotide is a RNAi oligonucleotide.

As used herein, "overhang" means a terminal non-base pairing nucleotide(s) resulting from one strand or region extending beyond the terminus of a complementary strand with which the one strand or region forms a duplex. An overhang may include one or more unpaired nucleotides extending from a duplex region at the 5' terminus or 3' terminus of a ds oligonucleotide. The overhang can be a 3' or 5' overhang on the antisense strand or sense strand of a ds oligonucleotides.

As used herein, "phosphate analog" means a chemical moiety that mimics the electrostatic and/or steric properties of a phosphate group. In some embodiments, a phosphate analog is positioned at the 5' terminal nucleotide of an oligonucleotide in place of a 5'-phosphate, which is often susceptible to enzymatic removal. A 5' phosphate analog can include a phosphatase-resistant linkage. Examples of phosphate analogs include, but are not limited to, 5' phosphonates, such as 5' methylene phosphonate (5'-MP) and 5'-(E)-vinylphosphonate (5'-VP). An oligonucleotide can have a phosphate analog at a 4'-carbon position of the sugar (referred to as a "4'-phosphate analog") at a 5'-terminal nucleotide. An example of a 4'-phosphate analog is oxymethylphosphonate, in which the oxygen atom of the oxymethyl group is bound to the sugar moiety (e.g., at its 4'-carbon) or analog thereof. See, e.g., Intl. Patent Application Publication No. WO 2018/045317. Other modifications have been developed for the 5' end of oligonucleotides (see, e.g., Intl. Patent Application No. WO 2011/133871; U.S. Pat. No. 8,927,513; and Prakash et al. (2015) NUCLEIC ACIDS RES. 43:2993-3011).

As used herein, "APOC3-associated disease," "APOC3-associated disorder" or "APOC3-associated condition" means conditions where increased APOC3 expression and/or the presence of, for example, a APOC3 polymorphism. Exemplary APOC3-associated conditions, diseases or disorders include, but are not limited to, AH, ACD, ALD, CCA, CHD, MetS, PSC, cirrhosis, hepatic fibrosis, hepatic inflammation, HCC, NAFLD, and NASH, as well as related diseases, disorders, and conditions in an individual such as, for example, hyperlipidemia, diabetes and/or obesity.

As used herein, "reduced expression," and with respect to a gene (e.g., APOC3) means a decrease in the amount or level of RNA transcript (e.g., APOC3 mRNA) or protein encoded by the gene and/or a decrease in the amount or level of activity of the gene in a cell, a population of cells, a sample, or an individual, when compared to an appropriate reference (e.g., a reference cell, population of cells, sample, or individual). For example, the act of contacting a cell with an oligonucleotide herein (e.g., an oligonucleotide having an antisense strand having a nucleotide sequence that is complementary to a nucleotide sequence including APOC3 mRNA) may result in a decrease in the amount or level of mRNA, protein, and/or activity (e.g., via degradation of APOC3 mRNA by the RNAi pathway) when compared to a cell that is not treated with the ds oligonucleotide. Similarly, and as used herein, "reducing expression" means an act that results in reduced expression of a gene (e.g., APOC3). Specifically, and as used herein, "reduction of APOC3 expression" means a decrease in the amount or level of APOC3 mRNA, APOC3 protein, and/or APOC3 activity in a cell, a population of cells, a sample, or an individual when compared to an appropriate reference (e.g., a reference cell, population of cells, tissue, or individual).

As used herein, "region of complementarity" means a sequence of nucleotides of a nucleic acid (e.g., a ds oligonucleotide) that is sufficiently complementary to an antiparallel sequence of nucleotides to permit hybridization between the two sequences of nucleotides under appropriate hybridization conditions (e.g., in a phosphate buffer, in a cell, etc.). An oligonucleotide herein includes a targeting sequence having a region of complementary to a mRNA target sequence.

As used herein, "ribonucleotide" means a nucleotide having a ribose as its pentose sugar, which contains a hydroxyl group at its 2' position. A modified ribonucleotide is a ribonucleotide having one or more modifications or substitutions of atoms other than at the 2' position, including modifications or substitutions in or of the nucleobase, sugar, or phosphate group.

As used herein, "RNAi oligonucleotide" refers to either (a) a ds oligonucleotide having a sense strand (passenger) and antisense strand (guide), in which the antisense strand or part of the antisense strand is used by the Argonaute 2 (Ago2) endonuclease in the cleavage of a target mRNA or (b) a ss oligonucleotide having a single antisense strand, where that antisense strand (or part of that antisense strand) is used by the Ago2 endonuclease in the cleavage of a target mRNA.

As used herein, "strand" refers to a single, contiguous sequence of nucleotides linked together through internucleotide linkages (e.g., phosphodiester linkages or phosphorothioate linkages). A strand can have two free ends (e.g., a 5' end and a 3' end).

As used herein, "individual" means any mammal, including cats, dogs, mice, rats, and primates, especially humans. Moreover, "subject" or "patient" may be used interchangeably with "individual."

As used herein, "synthetic" refers to a nucleic acid or other molecule that is artificially synthesized (e.g., using a machine such as, for example, a solid-state nucleic acid synthesizer) or that is otherwise not derived from a natural source (e.g., a cell or organism) that normally produces the nucleic acid or other molecule.

As used herein, "targeting ligand" means a molecule (e.g., an amino sugar, carbohydrate, cholesterol, lipid, or polypeptide) that selectively binds to a cognate molecule (e.g., a receptor) of a tissue or cell of interest and that is conjugatable to another substance for targeting another substance to the tissue or cell of interest. For example, a targeting ligand may be conjugated to an oligonucleotide herein for purposes of targeting the oligonucleotide to a specific tissue or cell of interest. A targeting ligand can selectively bind to a cell surface receptor. Accordingly, a targeting ligand, when conjugated to an oligonucleotide, facilitates delivery of the oligonucleotide into a particular cell through selective binding to a receptor expressed on the surface of the cell and endosomal internalization by the cell of the complex comprising the oligonucleotide, targeting ligand, and receptor. Moreover, a targeting ligand can be conjugated to an oligonucleotide via a linker that is cleaved following or during cellular internalization such that the oligonucleotide is released from the targeting ligand in the cell.

As used herein, "tetraloop" means a loop that increases stability of an adjacent duplex formed by hybridization of flanking sequences of nucleotides. The increase in stability is detectable as an increase in melting temperature ($T_m$) of an adjacent stem duplex that is higher than the $T_m$ of the adjacent stem duplex expected, on average, from a set of loops of comparable length consisting of randomly selected sequences of nucleotides. For example, a tetraloop can confer a $T_m$ of at least about 50° C., at least about 55° C., at least about 56° C., at least about 58° C., at least about 60° C., at least about 65° C., or at least about 75° C. in 10 mM NaHPO$_4$ to a hairpin comprising a duplex of at least 2 base pairs (bp) in length. A tetraloop also may stabilize a bp in an adjacent stem duplex by stacking interactions. Additionally, interactions among the nucleotides in a tetraloop include, but are not limited to, non-Watson-Crick base pairing, stacking interactions, hydrogen bonding, and contact interactions (Cheong et al. (1990) NATURE 346:680-82; Heus & Pardi (1991) SCIENCE 253:191-94). Here, a tetraloop can include or can have about 3 to 6 nucleotides, and typically is about 4 to 5 nucleotides. A tetraloop therefore can have 3, 4, 5, or 6 nucleotides, which may or may not be modified (e.g., which may or may not be conjugated to a targeting moiety), especially 4 nucleotides. Any nucleotide may be used in the tetraloop, and standard IUPAC-IUB symbols for such nucleotides may be used as described in Cornish-Bowden (1985) NUCLEIC ACIDS RES. 13:3021-30. For example, the letter "N" may be used to mean that any base may be in that position, the letter "R" may be used to show that A (adenine) or G (guanine) may be in that position, and "B" may be used to show that C (cytosine), G (guanine), or T (thymine) may be in that position. Examples of tetraloops include the UNCG family of tetraloops (e.g., UUCG), the GNRA family of tetraloops (e.g., GAAA) and the CUUG tetraloop (Woese et al. (1990) PROC. NATL. ACAD. SCI. USA 87:8467-71; Antao et al. (1991) NUCLEIC ACIDS RES. 19:5901-05). Examples of DNA tetraloops include the d(GNNA) family of tetraloops (e.g., d(GTTA)), the d(GNRA) family of tetraloops, the d(GNAB) family of tetraloops, the d(CNNG) family of tetraloops, and the d(TNCG) family of tetraloops (e.g., d(TTCG)). See, e.g., Nakano et al. (2002) BIOCHEM. 41:4281-92; and Shinji et al. (2000) NIPPON KAGAKKAI KOEN YOKOSHU 78:731. Here, the tetraloop can be within a nicked tetraloop structure.

As used herein, "treat" or "treating" means an act of providing care to an individual in need thereof, for example, by administering a therapeutic agent (e.g., an oligonucleotide herein) to the individual for purposes of improving the health and/or well-being of the individual with respect to an existing condition (e.g., a disease, disorder) or to prevent or decrease the likelihood of the occurrence of a condition. Treating also can involve reducing the frequency or severity of at least one sign, symptom or contributing factor of a condition (e.g., disease, disorder) experienced by the individual.

As used herein, "iRNA," "iRNA agent," "RNAi," "RNAi agent" and "RNA interference agent" means an agent that contains RNA and that mediates the targeted cleavage of an RNA-containing transcript via an RNA-induced silencing complex (RISC) pathway. RNAi directs sequence-specific degradation of mRNA via RNA interference. The RNAi modulates, inhibits, or reduces APOC3 expression in a cell.

Compositions

According to some aspects, the disclosure provides oligonucleotides (e.g., ds RNAi oligonucleotides) that reduce, modulate, or inhibit expression of APOC3 in the liver. In some embodiments, the oligonucleotides provided herein are used to treat of diseases associated with APOC3 expression. In some aspects, the disclosure provides methods of treatment of a disease associated with APOC3 expression by reducing, modulating, or inhibiting APOC3 expression in the liver (e.g., in cells comprising the liver).

Oligonucleotide Inhibitors of APOC3 Expression

I. APOC3 Target Sequences: The oligonucleotides herein (e.g., RNAi oligonucleotides) are targeted to a target sequence comprising APOC3 mRNA (i.e., a APOC3 target sequence). In some embodiments, the oligonucleotide or a portion, fragment, or strand thereof (e.g., an antisense strand or a guide strand of a ds RNAi oligonucleotide) binds or anneals to an APOC3 target sequence, thereby inhibiting APOC3 expression. In some embodiments, the oligonucleotide is targeted to a APOC3 target sequence for inhibiting APOC3 expression in vivo. In some embodiments, the amount or extent of APOC3 expression inhibition by an oligonucleotide targeted to an APOC3 target sequence correlates with the potency of the oligonucleotide. In some embodiments, the amount or extent of inhibition of APOC3 expression by an oligonucleotide targeted to an APOC3 target sequence correlates with the amount or extent of therapeutic benefit in an individual having or suspected of having a disease, disorder, or condition associated with APOC3 expression treated with the oligonucleotide.

Through examining and analyzing the nucleotide sequence of APOC3 mRNAs, including mRNAs of multiple different species (e.g., human and cynomolgus monkey; see, e.g., Example 1) and because of in vitro and in vivo testing (see, e.g., Examples 2-3), it is shown herein that certain nucleotide sequences of APOC3 mRNA are more amenable than others to oligonucleotide-based inhibition of APOC3 expression and are thus useful as target sequences for the oligonucleotides herein. In some embodiments, a sense strand of an oligonucleotide (e.g., a ds RNAi oligonucleotide) described herein (e.g., Table 2 or 3) comprises an APOC3 target sequence. In some embodiments, a portion or region of the sense strand of an oligonucleotide described herein (e.g., Table 2 or 3) comprises a APOC3 target sequence. In some embodiments, the APOC3 target sequence comprises, or consists of, a sequence of any one of SEQ ID NOs:334 to 341.

II. APOC3 mRNA Targeting Sequences: In some embodiments, the oligonucleotides herein have regions of complementarity to APOC3 mRNA (e.g., within a target sequence of APOC3 mRNA) for targeting APOC3 mRNA in cells and inhibiting APOC3 expression. In some embodiments, the oligonucleotides herein comprise an APOC3 targeting sequence (e.g., an antisense strand or a guide strand of a ds oligonucleotide) having a region of complementarity that binds or anneals to an APOC3 mRNA target sequence by complementary (Watson-Crick) base pairing. The targeting sequence or region of complementarity is of a suitable length and base content to enable binding or annealing of the oligonucleotide (or a strand thereof) to APOC3 mRNA for inhibiting its expression. In some embodiments, the targeting sequence or region of complementarity is at least about 12, at least about 13, at least about 14, at least about 15, at least about 16, at least about 17, at least about 18, at least about 19, at least about 20, at least about 21, at least about 22, at least about 23, at least about 24, at least about 25, at least about 26, at least about 27, at least about 28, at least about 29, or at least about 30 nucleotides in length. Alternatively, the targeting sequence or region of complementarity is about 12 to about 30 (e.g., 12 to 30, 12 to 22, 15 to 25, 17 to 21, 18 to 27, 19 to 27, or 15 to 30) nucleotides in length. Alternatively, the targeting sequence or region of complementarity is about 12, 13, 14, 15, 16, 17, 18, 19, 20, 21, 22, 23, 24, 25, 26, 27, 28, 29, or 30 nucleotides in length. In certain embodiments, the targeting sequence or region of complementarity is 18 nucleotides in length. In certain embodiments, the targeting sequence or region of complementarity is 19 nucleotides in length. In certain embodiments, the targeting sequence or region of complementarity is 20 nucleotides in length. In certain embodiments, the targeting sequence or region of complementarity is 21 nucleotides in length. In certain embodiments, the targeting sequence or region of complementarity is 22 nucleotides in length. In certain embodiments, the targeting sequence or region of complementarity is 23 nucleotides in length. In certain embodiments, the targeting sequence or region of complementarity is 24 nucleotides in length.

In some embodiments, the oligonucleotides herein comprise a targeting sequence or a region of complementarity (e.g., an antisense strand or a guide strand of a ds oligonucleotide) that is fully complementary to an APOC3 target sequence. In some embodiments, the targeting sequence or region of complementarity is partially complementary to an APOC3 target sequence. In some embodiments, the oligonucleotide comprises a targeting sequence or region of complementarity that is fully complementary to a sequence of any one of SEQ ID NOs:334 to 341. In some embodiments, the oligonucleotide comprises a targeting sequence or region of complementarity that is partially complementary to a sequence of any one of SEQ ID NOs:334 to 341.

Alternatively, in some embodiments, the oligonucleotides herein comprise a targeting sequence or region of complementarity that is complementary to a contiguous sequence of nucleotides comprising an APOC3 mRNA, where the contiguous sequence of nucleotides is about 12 to about 30 nucleotides in length (e.g., 12 to 30, 12 to 28, 12 to 26, 12 to 24, 12 to 20, 12 to 18, 12 to 16, 14 to 22, 16 to 20, 18 to 20, or 18 to 19 nucleotides in length). In some embodiments, the oligonucleotides comprise a targeting sequence or region of complementarity that is complementary to a contiguous sequence of nucleotides comprising an APOC3 mRNA, where the contiguous sequence of nucleotides is 10, 11, 12, 13, 14, 15, 16, 17, 18, 19, or 20 nucleotides in length. In some embodiments, the oligonucleotides comprise a targeting sequence or region of complementarity that is complementary to a contiguous sequence of nucleotides comprising an APOC3 mRNA, where the contiguous sequence of nucleotides is 19 nucleotides in length. In some embodiments, the oligonucleotides comprise a targeting sequence or region of complementarity that is complementary to a contiguous sequence of nucleotides comprising an APOC3 mRNA, where the contiguous sequence of nucleotides is 20 nucleotides in length. In other embodiments, the oligonucleotides comprise a targeting sequence or a region of complementarity that is complementary to a contiguous sequence of nucleotides of any one of SEQ ID NOs:334 to 341, optionally where the contiguous sequence of nucleotides is 19 nucleotides in length.

Regarding the targeting sequence or region of complementarity of the oligonucleotides herein, it is complementary to contiguous nucleotides of a sequence as set forth in any one of SEQ ID NOs:334 to 341 and spans the entire length of an antisense strand. In some embodiments, the region of complementarity of the oligonucleotides is complementary to contiguous nucleotides of a sequence as set forth in any one of SEQ ID NOs:334 to 341 and spans a portion of the entire length of an antisense strand. In some additional embodiments, the oligonucleotides include a region of complementarity (e.g., on an antisense strand of a ds oligonucleotide) that is at least partially (e.g., fully) complementary to a contiguous stretch of nucleotides spanning nucleotides 1-20, 1-19, 1-18, etc. of a sequence as set forth in any one of SEQ ID NOs:334 to 341.

Alternatively, the oligonucleotides herein comprise a targeting sequence or region of complementarity having one or more base pair (bp) mismatches with the corresponding APOC3 target sequence. In some embodiments, the targeting sequence or region of complementarity is up to about 1, up to about 2, up to about 3, up to about 4, up to about 5, etc.

mismatches with the corresponding APOC3 target sequence, provided that the ability of the targeting sequence or region of complementarity to bind or anneal to the APOC3 mRNA under appropriate hybridization conditions and/or the ability of the oligonucleotide to reduce or inhibit APOC3 expression is maintained. Stated differently, the targeting sequence or region of complementarity is no more than 1, no more than 2, no more than 3, no more than 4, or no more than 5 mismatches with the corresponding APOC3 target sequence provided that the ability of the targeting sequence or region of complementarity to bind or anneal to an APOC3 mRNA under appropriate hybridization conditions and/or the ability of the oligonucleotides to reduce or inhibit APOC3 expression is maintained. In some embodiments, the oligonucleotides comprise a targeting sequence or region of complementarity having 1 mismatch with the corresponding target sequence. In some embodiments, the oligonucleotides comprise a targeting sequence or region of complementarity having 2 mismatches with the corresponding target sequence. In some embodiments, the oligonucleotides comprise a targeting sequence or a region of complementarity having 3 mismatches with the corresponding target sequence. In some embodiments, the oligonucleotides comprise a targeting sequence or region of complementarity having 4 mismatches with the corresponding target sequence. In some embodiments, the oligonucleotides comprise a targeting sequence or region of complementarity having 5 mismatches with the corresponding target sequence. In other embodiments, the oligonucleotides comprise a targeting sequence or a region of complementarity more than one mismatch (e.g., 2, 3, 4, 5 or more mismatches) with the corresponding target sequence, where at least 2 (e.g., all) of the mismatches are positioned consecutively (e.g., 2, 3, 4, 5 or more mismatches in a row), or where the mismatches are interspersed in any position throughout the targeting sequence or region of complementarity. In other embodiments, the oligonucleotides comprise a targeting sequence or region of complementarity more than one mismatch (e.g., 2, 3, 4, 5 or more mismatches) with the corresponding target sequence, where at least 2 (e.g., all) of the mismatches are positioned consecutively (e.g., 2, 3, 4, 5 or more mismatches in a row), or where at least one or more non-mismatched bp is located between the mismatches, or a combination thereof.

III. Types of Oligonucleotides: A variety of oligonucleotide types and/or structures are useful for targeting APOC3 mRNA including, but not limited to, RNAi oligonucleotides, antisense oligonucleotides, miRNAs, etc. Any of the oligonucleotide types described herein or elsewhere are contemplated for use as a framework to incorporate a targeting sequence herein for the purposes of inhibiting APOC3 expression. In some embodiments, the oligonucleotides herein inhibit APOC3 expression by engaging with RNAi pathways upstream or downstream of Dicer involvement. For example, RNAi oligonucleotides have been developed with each strand having sizes of about 19-25 nucleotides with at least one 3' overhang of 1 to 5 nucleotides (see, e.g., U.S. Pat. No. 8,372,968). Longer oligonucleotides also have been developed that are processed by Dicer to generate active RNAi products (see, e.g., U.S. Pat. No. 8,883,996). Further work produced extended ds oligonucleotides where at least one end of at least one strand is extended beyond a duplex targeting region, including structures where one of the strands includes a thermodynamically stabilizing tetraloop structure (see, e.g., U.S. Pat. Nos. 8,513,207 and 8,927,705, as well as Intl. Patent Application Publication No. WO 2010/033225). Such structures include ss extensions (on one or both sides of the molecule) as well as ds extensions.

The oligonucleotides herein engage with the RNAi pathway downstream of the involvement of Dicer (e.g., Dicer cleavage). In some embodiments, the oligonucleotides have an overhang (e.g., of 1, 2, or 3 nucleotides in length) in the 3' end of the sense strand. In some embodiments, the oligonucleotides (e.g., siRNA) include a 21-nucleotide antisense strand that is antisense to a target mRNA (e.g., APOC3 mRNA) and a complementary sense strand, in which both strands anneal to form a 19-bp duplex and 2 nucleotide overhangs at either or both 3' ends. Longer oligonucleotide designs also are contemplated, including oligonucleotides having an antisense strand of 23 nucleotides and a sense strand of 21 nucleotides, where there is a blunt end on the right side of the molecule (3' end of sense strand/5' end of antisense strand) and a two nucleotide 3'-antisense strand overhang on the left side of the molecule (5' end of the sense strand/3' end of the antisense strand). In such molecules, there is a 21 bp duplex region. See, e.g., U.S. Pat. Nos. 9,012,138; 9,012,621 and 9,193,753.

The oligonucleotides herein comprise sense and antisense strands that are both in the range of about 17 to about 26 (e.g., 17 to 26, 20 to 25, or 21-23) nucleotides in length. In some embodiments, the oligonucleotides comprise a sense and antisense strand that are both in the range of about 19 to about 22 nucleotides in length. In some embodiments, the sense and antisense strands are of equal length. In some embodiments, the oligonucleotides comprise sense and antisense strands, such that there is a 3'-overhang on either the sense strand or the antisense strand, or both the sense and antisense strand. In some embodiments, for oligonucleotides having sense and antisense strands that are both in the range of about 21 to about 23 nucleotides in length, a 3'-overhang on the sense, antisense or both sense and antisense strands is 1 or 2 nucleotides in length. In some embodiments, the oligonucleotides comprise an antisense strand of 22 nucleotides and a sense strand of 20 nucleotides, where there is a blunt end on the right side of the molecule (3' end of sense strand/5' end of antisense strand) and a 2 nucleotide 3' antisense strand overhang on the left side of the molecule (5' end of the sense strand/3' end of the antisense strand). In such molecules, there is a 20-bp duplex region.

Other oligonucleotide designs for use herein include: 16-mer siRNAs (see, e.g., "NUCLEIC ACIDS IN CHEMISTRY & BIOLOGY," Blackburn (ed.), Royal Society of Chemistry, 2006), shRNAs (e.g., having 19 bp or shorter stems; see, e.g., Moore et al. (2010) METHODS MOL. BIOL. 629:141-58), blunt siRNAs (e.g., of 19 bps in length; see, e.g., Kraynack & Baker (2006) RNA 12:163-76), asymmetrical siRNAs (aiRNA; see, e.g., Sun et al. (2008) NAT. BIOTECHNOL. 26:1379-82), asymmetric shorter-duplex siRNA (see, e.g., Chang et al. (2009) MOL. THER. 17:725-32), fork siRNAs (see, e.g., Hohjoh (2004) FEBS LETT. 557:193-98), ss siRNAs (see, e.g., Elsner (2012) NAT. BIOTECHNOL. 30:1063), dumbbell-shaped circular siRNAs (see, e.g., Abe et al. (2007) J. AM. CHEM. SOC. 129:15108-09), and small internally segmented interfering RNA (sisiRNA; see, e.g., Bramsen et al. (2007) NUCLEIC ACIDS RES. 35:5886-97). Further non-limiting examples of oligonucleotide structures that may be used herein to reduce or inhibit APOC3 expression are miRNA, shRNA, and short siRNA (see, e.g., Hamilton et al. (2002) EMBO J. 21:4671-79; see also, U.S. Pat. No. 7,659,389).

Alternatively, the oligonucleotides herein are ss. Such structures include, but are not limited to, ss RNAi molecules. Recent efforts have demonstrated the activity of ss RNAi molecules (see, e.g., Matsui et al. (2016) MOL. THER. 24:946-55). In some embodiments, the oligonucleotides are ASOs. An ASO is a ss oligonucleotide that has a nucleobase sequence which, when written or depicted in the 5' to 3' direction, includes a reverse complement of a targeted segment of a particular nucleic acid and is suitably modified (e.g., as a gapmer) to induce RNaseH-mediated cleavage of its target RNA in cells or (e.g., as a mixmer) so as to inhibit translation of the target mRNA in cells. ASOs for use herein are modified in any suitable manner known in the art including, for example, as shown in U.S. Pat. No. 9,567,587 (including, for example, length, sugar moieties of the nucleobase (pyrimidine, purine), and alterations of the heterocyclic portion of the nucleobase). Further, ASOs have been used for decades to reduce expression of specific target genes (see, e.g., Bennett et al. (2017) ANNU. REV. PHARMACOL. 57:81-105).

IV. ds RNAi Oligonucleotides: ds oligonucleotides for targeting APOC3 mRNA and inhibiting APOC3 expression (e.g., via the RNAi pathway) comprising a sense strand (i.e., a passenger strand) and an antisense strand (i.e., a guide strand). In some embodiments, the sense strand and antisense strand are separate strands and are not covalently linked. In some embodiments, the sense strand and antisense strand are covalently linked.

In some embodiments, the sense strand comprises a first region (R1) and a second region (R2), where R2 comprises a first subregion (S1), a triL or a L, and a second subregion (S2), where triL or L is located between S1 and S2, and where S1 and S2 form a second duplex (D2). D2 has various lengths. In some embodiments, D2 is about 1 to about 6 bp in length. In other embodiments, D2 is 2-6, 3-6, 4-6, 5-6, 1-5, 2-5, 3-5 or 4-5 bp in length. In other embodiments, D2 is 1, 2, 3, 4, 5 or 6 bp in length. In certain embodiments, D2 is 6 bp in length.

In some embodiments, R1 of the sense strand and the antisense strand forms a first duplex (D1). In some embodiments, D1 is at least about 15 (e.g., at least 15, at least 16, at least 17, at least 18, at least 19, at least 20 or at least 21) nucleotides in length. In other embodiments, D1 is about 12 to about 30 nucleotides in length (e.g., 12 to 30, 12 to 27, 15 to 22, 18 to 22, 18 to 25, 18 to 27, 18 to 30 or 21 to 30 nucleotides in length). In other embodiments, D1 is at least 12 nucleotides in length (e.g., at least 12, at least 15, at least 20, at least 25 or at least 30 nucleotides in length). In other embodiments, D1 is 12, 13, 14, 15, 16, 17, 18, 19, 20, 21, 22, 23, 24, 25, 26, 27, 28, 29 or 30 nucleotides in length. In certain embodiments, D1 is 20 nucleotides in length. In some embodiments, D1 does not span the entire length of the sense strand and/or antisense strand. In other embodiments, D1 spans the entire length of either the sense strand or antisense strand or both. In certain embodiments, D1 spans the entire length of both the sense strand and the antisense strand.

In certain embodiments, the disclosure describes RNAi oligonucleotides for reducing or inhibiting APOC3 expression that include a sense strand having (comprising or consisting of) a sequence as set forth in Table 2 (e.g., any one of the odd numbers of SEQ ID NOs:9 to 170), especially SEQ ID NOs:37, 43, 45, 87, 89, 99, 101, and 105.

In certain embodiments, the disclosure describes RNAi oligonucleotides for reducing or inhibiting APOC3 expression that include an antisense strand having (comprising or consisting of) a sequence as set forth in Table 2 (e.g., any one of the even numbers of SEQ ID NOs:9 to 170), especially SEQ ID NOs:38, 44, 46, 88, 90, 100, 102, and 106.

In certain other embodiments, the RNAi oligonucleotide includes a sense strand having (comprising or consisting of) a nucleotide sequence of any one of SEQ ID NOs:37, 43, 45, 87, 89, 99, 101, and 105, and an antisense strand having (comprising, or consisting of) a nucleotide sequence of any one of SEQ ID NOs:38, 44, 46, 88, 90, 100, 102, and 106.

In certain additional embodiments, the RNAi oligonucleotide includes a sense strand having (comprising or consisting of) a nucleotide sequence of any one of SEQ ID NOs:37, 89 and 101, and an antisense strand having (comprising, or consisting of) a nucleotide sequence of any one of SEQ ID NOs:38, 90 and 102.

In certain embodiments, the sense strand, and the antisense strand of the RNAi oligonucleotide, respectively, are selected from:
  (a) SEQ ID NOs:37 and 38,
  (b) SEQ ID NOs:43 and 44,
  (c) SEQ ID NOs:45 and 46,
  (d) SEQ ID NOs:87 and 88,
  (e) SEQ ID NOs:89 and 90,
  (f) SEQ ID NOs:99 and 100,
  (g) SEQ ID NOs:101 and 102, and
  (h) SEQ ID NOs:105 and 106.

In some embodiments, the RNAi oligonucleotide includes a sense strand having (comprising or consisting of) a nucleotide sequence as set for the in Table 3 (e.g., any one of the odd numbers of SEQ ID NOs:171 to 332), especially SEQ ID NOs:199, 205, 207, 249, 251, 261, 263, and 267.

In certain embodiments, the RNAi oligonucleotide includes an antisense strand having (comprising or consisting of) a nucleotide sequence as set forth in Table 3 (e.g., any one of the even numbers of SEQ ID NOs:171 to 332), especially 200, 206, 208, 250, 252, 262, 264, and 268.

In certain other embodiments, the RNAi oligonucleotide includes a sense strand having (comprising or consisting of) a nucleotide sequence of any one of SEQ ID NOs:199, 205, 207, 249, 251, 261, 263 and 267, and an antisense strand having (comprising, or consisting of) a nucleotide sequence of any one of SEQ ID NOs: 200, 206, 208, 250, 252, 262, 264 and 268.

In certain additional embodiments, the RNAi oligonucleotide includes a sense strand having (comprising or consisting of) a nucleotide sequence of any one of SEQ ID NOs:199, 251 and 263, and an antisense strand having (comprising, or consisting of) a nucleotide sequence of any one of SEQ ID NOs:200, 252 and 264.

In certain embodiments, the sense strand, and the antisense strand of the RNAi oligonucleotide, respectively, are selected from:
  (a) SEQ ID NOs:199 and 200,
  (b) SEQ ID NOs:205 and 206,
  (c) SEQ ID NOs:207 and 208,
  (d) SEQ ID NOs:249 and 250,
  (e) SEQ ID NOs:251 and 252,
  (f) SEQ ID NOs:261 and 262,
  (g) SEQ ID NOs:263 and 264, and
  (h) SEQ ID NOs:267 and 268.

One of skill in the art appreciates that in some embodiments, the sequences presented in the Sequence Listing is referred to in describing the structure of an oligonucleotide (e.g., a ds oligonucleotide) or other nucleic acid. In such embodiments, the actual oligonucleotide or other nucleic acid has one or more alternative nucleotides (e.g., an RNA counterpart of a DNA nucleotide or a DNA counterpart of an RNA nucleotide) and/or one or more modified nucleotides and/or one or more modified internucleotide linkages and/or one or more other modification when compared with the specified sequence while retaining essentially same or similar complementary properties as the specified sequence.

In some embodiments, a ds oligonucleotide herein includes a 25-nucleotide sense strand and a 27-nucleotide antisense strand that when acted upon by a Dicer enzyme results in an antisense strand that is incorporated into the mature RISC. In other embodiments, the sense strand of the ds oligonucleotide is longer than 25 nucleotides (e.g., 26, 27, 28, 29, or 30 nucleotides). In other embodiments, the sense strand of the ds oligonucleotide is longer than 27 nucleotides (e.g., 28, 29, 30, 31, 32, 33, 34, 35, 36, 37, 38, 39, or 40 nucleotides).

In some embodiments, the ds oligonucleotides herein have one 5' end that is thermodynamically less stable when compared to the other 5' end. In some embodiments, the ds oligonucleotide is asymmetric and includes a blunt end at the 3' end of a sense strand and a 3'-overhang at the 3' end of an antisense strand. In some embodiments, the 3'-overhang on the antisense strand is about 1 to about 8 nucleotides in length (e.g., 1, 2, 3, 4, 5, 6, 7, or 8 nucleotides in length). Typically, a ds oligonucleotide for RNAi has a two-nucleotide overhang on the 3' end of the antisense (guide) strand. However, other overhangs are possible. In some embodiments, an overhang is a 3'-overhang having a length of between about 1 to about 6 nucleotides, optionally 1 to 5, 1 to 4, 1 to 3, 1 to 2, 2 to 6, 2 to 5, 2 to 4, 2 to 3, 3 to 6, 3 to 5, 3 to 4, 4 to 6, 4 to 5, 5 to 6 nucleotides, or 1, 2, 3, 4, 5, or 6 nucleotides. However, in other embodiments, the overhang is a 5'-overhang comprising a length of between about 1 to about 6 nucleotides, optionally 1 to 5, 1 to 4, 1 to 3, 1 to 2, 2 to 6, 2 to 5, 2 to 4, 2 to 3, 3 to 6, 3 to 5, 3 to 4, 4 to 6, 4 to 5, 5 to 6 nucleotides, or 1, 2, 3, 4, 5, or 6 nucleotides.

In some embodiments, two terminal nucleotides on the 3' end of an antisense strand are modified. In some embodiments, the two terminal nucleotides on the 3' end of the antisense strand are complementary with the target mRNA (e.g., APOC3 mRNA). In other embodiments, the two terminal nucleotides on the 3' end of the antisense strand are not complementary with the target mRNA. In some embodiments, two terminal nucleotides on each 3' end of an oligonucleotide in the nicked tetraloop structure are GG. Typically, one or both of the two terminal GG nucleotides on each 3' end of a ds oligonucleotide is not complementary with the target mRNA.

In some embodiments, there is one or more (e.g., 1, 2, 3, 4, or 5) mismatch(es) between the sense and antisense strand. If there is more than one mismatch between the sense and antisense strand, they may be positioned consecutively (e.g., 2, 3, or more in a row), or interspersed throughout the region of complementarity. In some embodiments, the 3' end of the sense strand contains one or more mismatches. In certain embodiments, two mismatches are incorporated at the 3' end of the sense strand. In some embodiments, base mismatches, or destabilization of segments at the 3' end of the sense strand of the oligonucleotide improves or increases the potency of the ds oligonucleotide.

A. Sense Strands: The oligonucleotides (e.g., a ds oligonucleotide) herein for targeting an APOC3 mRNA and inhibiting APOC3 expression include a sense strand sequence including a sequence as set forth in the sense strands of Table 2 or Table 3. In some embodiments, the oligonucleotides include a sense strand that having at least about 12 (e.g., at least 13, at least 14, at least 15, at least 16, at least 17, at least 18, at least 19, at least 20, at least 21, at least 22, or at least 23) contiguous nucleotides of a sequence as set forth in in any one of SEQ ID NOs:37, 43, 45, 87, 89, 99, 101 and 105, or a sense strand having a nucleotide sequence of any one of SEQ ID NOs:199, 205, 207, 249, 251, 261, 263 and 267.

Further, the oligonucleotides (e.g., ads oligonucleotide) herein include a sense strand (or passenger strand) of up to about 40 nucleotides in length (e.g., up to 40, up to 36, up to 30, up to 27, up to 25, up to 21, up to 19, up to 17, or up to 12 nucleotides in length). In some embodiments, the oligonucleotides can have a sense strand of at least about 12 nucleotides in length (e.g., at least 12, at least 15, at least 19, at least 21, at least 25, at least 27, at least 30, at least 36, or at least 38 nucleotides in length). Alternatively, the oligonucleotides can have a sense strand in a range of about 12 to about 40 (e.g., 12 to 40, 12 to 36, 12 to 32, 12 to 28, 15 to 40, 15 to 36, 15 to 32, 15 to 28, 17 to 21, 17 to 25, 19 to 27, 19 to 30, 20 to 40, 22 to 40, 25 to 40, or 32 to 40) nucleotides in length. In certain embodiments, the oligonucleotides can have a sense strand of 12, 13, 14, 15, 16, 17, 18, 19, 20, 21, 22, 23, 24, 25, 26, 27, 28, 29, 30, 31, 32, 33, 34, 35, 36, 37, 38, 39, or 40 nucleotides in length.

Figure 1B:
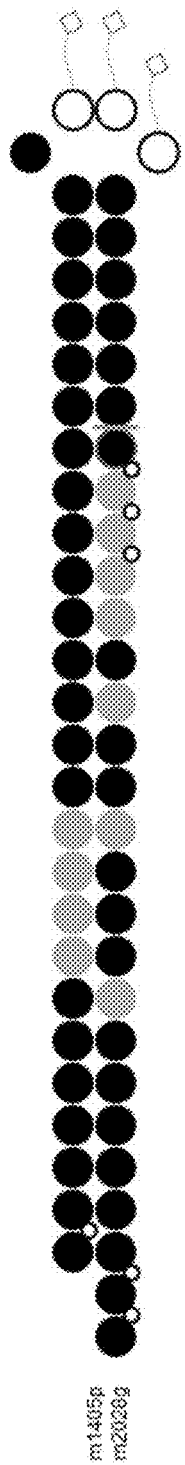
Figure 1B:
Figure 1B:
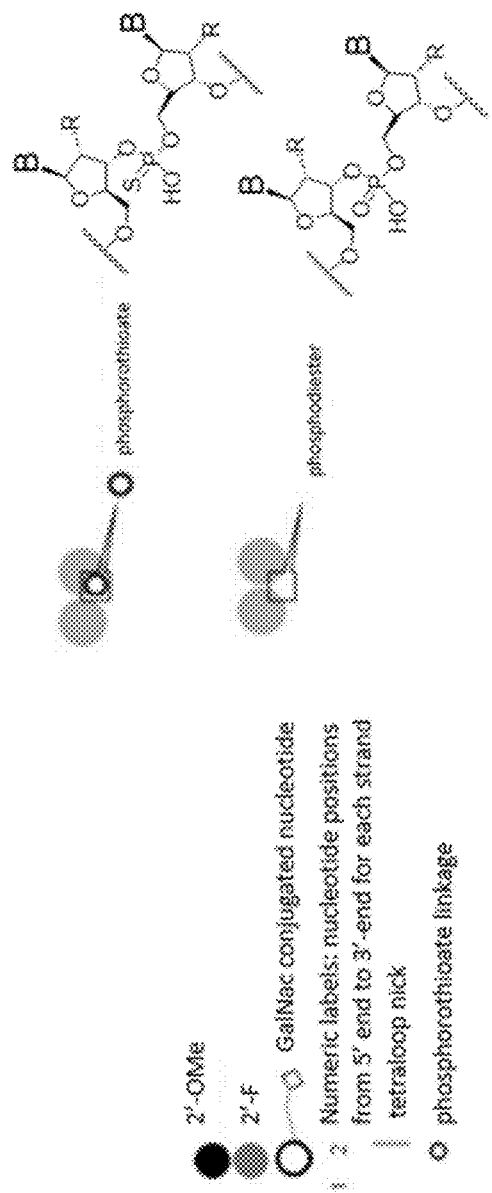
Figure 1C:
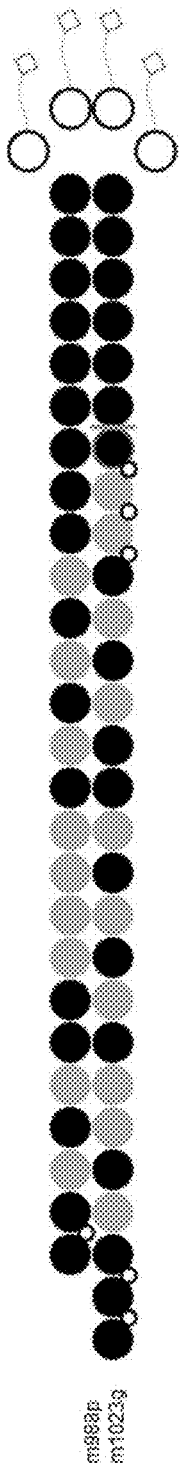
Figure 1C:
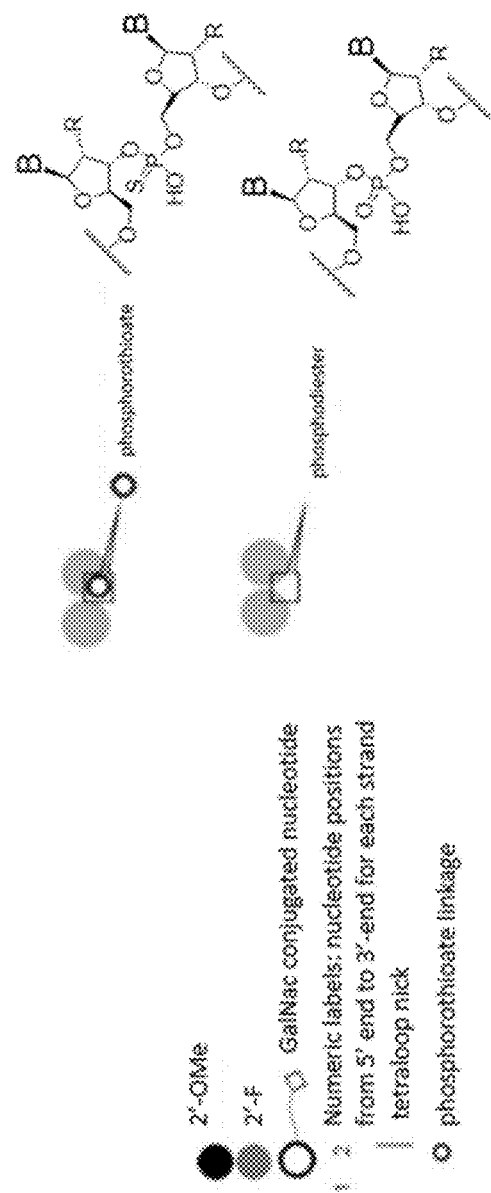

In some embodiments, the sense strand comprises a stem-loop structure at its 3' end. In other embodiments, the sense strand comprises a stem-loop structure at its 5' end. In additional embodiments, the stem is a duplex of about 2, 3, 4, 5, 6, 7, 8, 9, 10, 11, 12, 13, or 14 bp in length. In some embodiments, the stem-loop provides the oligonucleotides protection against degradation (e.g., enzymatic degradation) and facilitates or improves targeting and/or delivery to a target cell, tissue, or organ (e.g., the liver), or both. For example, the loop of the stem-loop provides nucleotides having one or more modifications that facilitate, improve, or increase targeting to a target mRNA (e.g., an APOC3 mRNA), inhibiting of target gene expression (e.g., APOC3 expression), and/or delivering to a target cell, tissue, or organ (e.g., the liver), or both. In some embodiments, the stem-loop itself or modification(s) to the stem-loop do not substantially affect the inherent gene expression inhibition activity of the oligonucleotide, but facilitates, improves, or increases stability (e.g., provides protection against degradation) and/or delivery of the oligonucleotide to a target cell, tissue, or organ (e.g., the liver). In certain embodiments, the oligonucleotides comprise a sense strand including (e.g., at its 3' end) a stem-loop set forth as: S1-L-S2, in which S1 is complementary to S2, and in which L forms a ss loop between S1 and S2 of up to about 10 nucleotides in length (e.g., 3, 4, 5, 6, 7, 8, 9, or 10 nucleotides in length). In certain embodiments, the loop (L) is 4 nucleotides in length. FIGS. 1A-1C depict non-limiting examples of such an oligonucleotide. In some embodiments the loop (L) of the stem-loop having the structure S1-L-S2 as described above is a tetraloop (e.g., within a nicked tetraloop structure). In some embodiments, the tetraloop comprises ribonucleotides, deoxyribonucleotides, modified nucleotides, delivery ligands and combinations thereof.

B. Antisense Strands: The oligonucleotides (e.g., a ds oligonucleotide) herein for targeting an APOC3 mRNA and inhibiting APOC3 expression include an antisense strand including a sequence as set forth in the antisense strands of Table 2 or Table 3. In some embodiments, the oligonucleotides include an antisense strand having at least about 12 (e.g., at least 12, at least 13, at least 14, at least 15, at least 16, at least 17, at least 18, at least 19, at least 20, at least 21, at least 22, or at least 23) contiguous nucleotides of a sequence as set forth in any one of SEQ ID NOs:38, 44, 46, 88, 90, 100, 102 and 106, or an antisense strand having a nucleotide sequence of any one of SEQ ID NOs:200, 206, 208, 250, 252, 262, 264 and 268.

Further, the oligonucleotides (e.g., a ds oligonucleotide) herein can include an antisense strand of up to about 40 nucleotides in length (e.g., up to 40, up to 35, up to 30, up to 27, up to 25, up to 21, up to 19, up to 17, or up to 12 nucleotides in length). In some embodiments, the oligonucleotides can have an antisense strand of at least about 12 nucleotides in length (e.g., at least 12, at least 15, at least 19, at least 21, at least 22, at least 25, at least 27, at least 30, at least 35, or at least 38 nucleotides in length). Alternatively, the oligonucleotides can have an antisense strand in a range of about 12 to about 40 (e.g., 12 to 40, 12 to 36, 12 to 32, 12 to 28, 15 to 40, 15 to 36, 15 to 32, 15 to 28, 17 to 22, 17 to 25, 19 to 27, 19 to 30, 20 to 40, 22 to 40, 25 to 40, or 32 to 40) nucleotides in length. In certain embodiments, the oligonucleotide can have an antisense strand of 12, 13, 14, 15, 16, 17, 18, 19, 20, 21, 22, 23, 24, 25, 26, 27, 28, 29, 30, 31, 32, 33, 34, 35, 36, 37, 38, 39, or 40 nucleotides in length.

As noted above, the antisense strand of the oligonucleotides herein may be referred to as the "guide strand." For example, the antisense strand that engages with RISC and that binds to an Argonaute protein such as Ago2, or that engages with or that binds to one or more similar factors, and directs silencing of a target gene, the antisense strand is referred to as a guide strand (or "passenger strand").

V. Oligonucleotide Modifications:

A. Sugar Modifications: A modified sugar (also referred to herein as a sugar analog) includes a modified deoxyribose or ribose moiety in which, for example, one or more modifications occur at the 2', 3', 4', and/or 5' carbon position of the sugar. A modified sugar also includes non-natural, alternative, carbon structures such as those present in locked nucleic acids ("LNA"; see, e.g., Koshkin et al. (1998) TETRAHEDRON 54:3607-30), unlocked nucleic acids ("UNA"; see, e.g., Snead et al. (2013) MOL. THER-NUC. ACIDS 2:e103) and bridged nucleic acids ("BNA"; see, e.g., Imanishi & Obika (2002) CHEM. COMMUN. 16:1653-59).

In some embodiments, the nucleotide modification in the sugar is a 2-modification such as, for example, 2'-O-propargyl, 2-O-propylamin, 2'-amino, 2'-ethyl, 2'-F, 2'-aminoethyl (EA), 2'-OMe, 2'-MOE, 2'-O-[2-(methylamino)-2-oxoethyl] (2'-O-NMA), or 2'-FANA. In certain embodiments, the modification is 2'-F, 2'-OMe, or 2'-MOE. In other embodiments, the modification in the sugar is a modification of the sugar ring, which includes modification of one or more carbons of the sugar ring. For example, the modification in the sugar is a 2'-oxygen of the sugar linked to a 1-carbon or 4'-carbon of the sugar, or a 2'-oxygen linked to the 1'-carbon or 4'-carbon via an ethylene or methylene bridge. In other embodiments, the modification is an acyclic sugar that lacks a 2'-carbon to 3'-carbon bond. In other embodiments, the modification is a thiol group such as, for example, in the 4' position of the sugar.

The oligonucleotides herein include at least 1 modified nucleotide (e.g., at least 1, at least 5, at least 10, at least 15, at least 20, at least 25, at least 30, at least 35, at least 40, at least 45, at least 50, at least 55, at least 60, or more). In some embodiments, the sense strand comprises at least 1 modified nucleotide (e.g., at least 1, at least 5, at least 10, at least 15, at least 20, at least 25, at least 30, at least 35, or more). In some embodiments, the antisense strand comprises at least 1 modified nucleotide (e.g., at least 1, at least 5, at least 10, at least 15, at least 20, or more).

In certain embodiments, all nucleotides of the sense strand except the tetraloop are modified. Likewise, all nucleotides of the antisense strand are modified. In some embodiments, all the ds nucleotides of the oligonucleotides herein (i.e., paired nucleotides of the sense strand and the antisense strand) are modified. As above, and in some embodiments, the modified nucleotide is a 2-modification (e.g., a 2'-F, 2'-OMe, 2'-MOE, and/or 2'-FANA. In certain embodiments, the modified nucleotide is a 2-modification such as, for example, a 2'-F or a 2'-OMe.

Moreover, the oligonucleotides herein have different modification patterns. In some embodiments, the modified oligonucleotides comprise an antisense strand having a modification pattern as set forth in Table 3 and comprise a sense strand sequence having a modification pattern as set forth in Table 3 (as well as FIGS. 1A-1C). In some embodiments, one or more of positions 8, 9, 10, or 11 of the sense strand are modified with a 2'-F. In other embodiments, the sugar moiety at each nucleotide at positions 1 to 7, 12 to 27 and 31 to 36 in the sense strand is modified with a 2'-OMe. In certain embodiments, positions 8 to 11 of the sense strand are modified with a 2'-F and positions 1 to 7, 12 to 27 and 31 to 36 are modified with a 2'-OMe.

In certain additional embodiments, a sense strand comprising a 2'-F modified nucleotide at positions 8-11, a 2'-OMe modified nucleotide at positions 1 to 7, 12 to 27 and 31 to 36, a GalNAc-conjugated nucleotide at position 28, 29 and 30, and a phosphorothioate linkage between positions 1 and 2.

In some embodiments, the antisense strand comprises one or more nucleotides at positions 2-5, 7, 10 and 14 modified with 2'-F, and one or more nucleotides at positions 1, 6, 8 to 9, 11 to 13 and 15 to 22 modified with a 2'-OMe. Certain embodiments disclose an oligonucleotide with an antisense strand comprising a 2'-F-modified nucleotide at positions 2 to 5, 7, 10 and 14, and a 2'-OMe-modified nucleotide at positions 1, 6, 8 to 9, 11 to 13 and 15 to 22.

In certain embodiments the antisense strand comprises a 2'-F modified nucleotide at positions 2 to 5, 7, 10 and 14, a 2'-OMe at positions 1, 6, 8 to 9, 11 to 13 and 15 to 22, a phosphorothioate linkage between positions 1 and 2, positions 2 and 3, positions 3 and 4, positions 20 and 21, and positions 21 and 22

B. 5'-Terminal Phosphates: 5'-terminal phosphate groups can be used to enhance the interaction of the oligonucleotides herein with Ago2. However, oligonucleotides having a 5'-phosphate group may be susceptible to degradation via phosphatases or other enzymes, which can limit their bioavailability in vivo. In some embodiments, the oligonucleotides herein (e.g., a ds oligonucleotide) comprise analogs of 5' phosphates that are resistant to such degradation. Examples of such phosphate analogs include, but are not limited to, oxymethylphosphonate, vinylphosphonate, malonyl phosphonate, or a combination thereof. In certain embodiments the 3' end of a strand of the oligonucleotides is attached to a chemical moiety that mimics the electrostatic and steric properties of a natural 5'-phosphate group ("phosphate mimic").

Alternatively, or additionally, the oligonucleotides herein have a phosphate analog at a 4'-carbon position of the sugar (referred to as a "4'-phosphate analog"). See, e.g., Intl. Patent Application Publication No. WO 2018/045317. In some embodiments, the oligonucleotides herein include a 4'-phosphate analog at a 5'-terminal nucleotide. In some embodiments, the phosphate analog is an oxymethylphosphonate, in which the oxygen atom of the oxymethyl group is bound to the sugar moiety (e.g., at its 4'-carbon) or analog thereof. In other embodiments, the 4'-phosphate analog is a thiomethylphosphonate or an aminomethylphosphonate, in which the sulfur atom of the thiomethyl group or the nitrogen atom of the amino methyl group is bound to the 4'-carbon of the sugar moiety or analog thereof. In certain embodiments, the 4'-phosphate analog is an oxymethylphosphonate, which is represented by the formula —O—CH$_2$—PO(OH)$_2$ or —O—CH$_2$—PO(OR)$_2$, in which R is independently selected from H, CH$_3$, an alkyl group, CH$_2$CH$_2$CN, CH$_2$OCOC(CH$_3$)$_3$, CH$_2$OCH$_2$CH$_2$Si(CH$_3$)$_3$, or a protecting group. In certain embodiments, the alkyl group is CH$_2$CH$_3$. In certain other embodiments, R is independently selected from H, CH$_3$, or CH$_2$CH$_3$.

C. Modified Internucleotide Linkages: In addition to the above modifications, the oligonucleotides herein (e.g., a ds oligonucleotide) comprise a modified internucleotide linkage. In some embodiments, phosphate modifications or substitutions result in oligonucleotides that comprise at least about 1 (e.g., at least 1, at least 2, at least 3, or at least 5) modified internucleotide linkages. In some embodiments, the oligonucleotides herein (e.g., a ds oligonucleotide) comprise about 1 to about 10 (e.g., 1 to 10, 2 to 8, 4 to 6, 3 to 10, 5 to 10, 1 to 5, 1 to 3, or 1 to 2) modified internucleotide linkages. In other embodiments, the oligonucleotides comprise 1, 2, 3, 4, 5, 6, 7, 8, 9, or 10 modified internucleotide linkages.

Examples of modified internucleotide linkages include, but are not limited to, a phosphorodithioate linkage, a phosphorothioate linkage, a phosphotriester linkage, a thionoalkylphosphonate linkage, a thionalkylphosphotriester linkage, a phosphoramidite linkage, a phosphonate linkage, or a boranophosphate linkage. In some embodiments, at least one modified internucleotide linkage of any one of the oligonucleotides as disclosed herein is a phosphorothioate linkage.

In some embodiments, the oligonucleotides herein include a phosphorothioate linkage between one or more of positions 1 and 2 of the sense strand, positions 1 and 2 of the antisense strand, positions 2 and 3 of the antisense strand, positions 3 and 4 of the antisense strand, positions 20 and 21 of the antisense strand, and positions 21 and 22 of the antisense strand. In other embodiments, the oligonucleotides comprise a phosphorothioate linkage between each of positions 1 and 2 of the sense strand, positions 1 and 2 of the antisense strand, positions 2 and 3 of the antisense strand, positions 3 and 4 of the antisense strand positions 20 and 21 of the antisense strand, and positions 21 and 22 of the antisense strand.

In certain embodiments, an oligonucleotide herein includes:

a sense strand having a 2'-F modified nucleotide at positions 8 to 11, a 2'-OMe modified nucleotide at positions 1 to 7, 12 to 27 and 31 to 36, a GalNAc-conjugated nucleotide at position 28, 29 and 30, and a phosphorothioate linkage between positions 1 and 2;

an antisense strand having a 2'-F modified nucleotide at positions 2 to 5, 7, 10 and 14, a 2'-OMe at positions 1, 6, 8 to 9, 11 to 13 and 15 to 22, a phosphorothioate linkage between positions 1 and 2, positions 2 and 3, positions 3 and 4, positions 20 and 21, and positions 21 and 22, and a 5'-terminal nucleotide at position 1 comprising a 4'-phosphate analog, optionally wherein the 5'-terminal nucleotide comprises 4-O-monomethylphosphonate-2'-O-methyl uridine [MePhosphonate-4O-mU]; where positions 1 to 20 of the antisense strand form a duplex region with positions 1 to 20 of the sense strand, where positions 21 to 36 of the sense strand form a stem-loop, where positions 27 to 30 form the loop of the stem-loop, optionally where positions 27 to 30 comprise a tetraloop, where positions 21 and 22 of the antisense strand comprise an overhang, and where the sense strand and antisense strands include nucleotide sequences selected from the group consisting of:

(a) SEQ ID NOs:199 and 200,
(b) SEQ ID NOs:205 and 206,
(c) SEQ ID NOs:207 and 208,
(d) SEQ ID NOs:249 and 250,
(e) SEQ ID NOs:251 and 252,
(f) SEQ ID NOs:261 and 262,
(g) SEQ ID NOs:263 and 264, and
(h) SEQ ID NOs:267 and 268.

D. Base Modifications: In addition to the above modifications, the oligonucleotides herein (e.g., a ds oligonucleotide) also comprise one or more modified nucleobases. In some embodiments, modified nucleobases (also referred to herein as base analogs) are linked at the 1' position of a nucleotide sugar moiety. In some embodiments, the modified nucleobase is a nitrogenous base. In other embodiments, the modified nucleobase does not contain nitrogen atom. See, e.g., US Patent Application Publication No. 2008/0274462. In certain other embodiments, the modified nucleotide is a universal base. However, in certain embodiments, the modified nucleotide does not contain a nucleobase (abasic).

With regard to universal bases, they comprise a heterocyclic moiety located at the 1' position of a nucleotide sugar moiety in a modified nucleotide, or the equivalent position in a nucleotide sugar moiety substitution, that, when present in a duplex, is positioned opposite more than one type of base without substantially altering structure of the duplex. Moreover, and compared to a reference ss nucleic acid (e.g., oligonucleotide) that is fully complementary to a target nucleic acid, a ss nucleic acid having a universal base forms a duplex with the target nucleic acid that has a lower T$_m$ than a duplex formed with the complementary nucleic acid. However, when compared to a reference ss nucleic acid in which the universal base has been replaced with a base to generate a single mismatch, the ss nucleic acid having the universal base forms a duplex with the target nucleic acid that has a higher T$_m$ than a duplex formed with the nucleic acid having the mismatched base.

Exemplary universal-binding nucleotides include, but are not limited to, inosine, 1-β-D-ribofuranosyl-5-nitroindole and/or 1-β-D-ribofuranosyl-3-nitropyrrole (see, e.g., US Patent Application Publication No. 2007/0254362; Van Aerschot et al. (1995) NUCLEIC ACIDS RES. 23:4363-70; Loakes et al. (1995) NUCLEIC ACIDS RES. 23:2361-66; and Loakes & Brown (1994) NUCLEIC ACIDS RES. 22:4039-403).

E. Reversible Modifications: While certain modifications can be made to protect the oligonucleotides herein (e.g., a ds oligonucleotide) from the in vivo environment before reaching target cells, they also can be made to reduce the potency or activity of the oligonucleotides once they reach the cytosol of the target cell. Reversible modifications therefore can be made such that the oligonucleotides retain desirable properties outside of the cell, which are then removed upon entering the cytosolic environment of the cell. Reversible modification can be removed, for example, by the action of an intracellular enzyme or by the chemical conditions inside of a cell (e.g., through reduction by intracellular glutathione).

In some embodiments, a reversibly modified nucleotide comprises a glutathione-sensitive moiety. Typically, oligonucleotides are chemically modified with cyclic disulfide moieties to mask the negative charge created by the internucleotide diphosphate linkages and to improve cellular uptake and nuclease resistance. See, US Patent Application Publication No. 2011/0294869, Intl. Patent Application Publication Nos. WO 2014/088920 and WO 2015/188197, and Meade et al. (2014) NAT. BIOTECHNOL. 32:1256-63. This reversible modification of the internucleotide diphosphate linkages is designed to be cleaved intracellularly by the reducing environment of the cytosol (e.g., glutathione). Earlier examples include neutralizing phosphotriester modifications that are reported to be cleavable inside cells (see, e.g., Dellinger et al. (2003) J. AM. CHEM. SOC. 125:940-50).

Some reversible modifications protect the oligonucleotides during in vivo administration (e.g., transit through the blood and/or lysosomal/endosomal compartments of a cell) where the oligonucleotides will be exposed to nucleases and other harsh environmental conditions (e.g., pH). When released into the cytosol of a cell where the levels of glutathione are higher compared to extracellular space, the modification is reversed, and the result is cleaved oligonucleotides. Using reversible, glutathione-sensitive moieties, it is possible to introduce sterically larger chemical groups into the oligonucleotides when compared to the options available using irreversible chemical modifications. This is because these larger chemical groups will be removed in the cytosol and, therefore, should not interfere with the biological activity of the oligonucleotides inside the cytosol of a cell. As a result, these larger chemical groups can be engineered to confer various advantages to the oligonucleotides, such as nuclease resistance, lipophilicity, charge, thermal stability, specificity, and reduced immunogenicity. In some embodiments, the structure of the glutathione-sensitive moiety can be engineered to modify the kinetics of its release.

In some embodiments, the glutathione-sensitive moiety is attached to the sugar of the nucleotide. In certain embodiments, the glutathione-sensitive moiety is attached to the 2'-carbon of the sugar of a modified nucleotide. Additionally, or alternatively, the glutathione-sensitive moiety is attached to the 5'-carbon of a sugar, particularly when the modified nucleotide is the 5'-terminal nucleotide of the oligonucleotides. Additionally, or alternatively, the glutathione-sensitive moiety is attached to the 3'-carbon of sugar, particularly when the modified nucleotide is the 3'-terminal nucleotide of the oligonucleotides. In some embodiments, the glutathione-sensitive moiety includes a sulfonyl group (see, e.g., Intl. Patent Application Publication No. WO 2018/039364).

VI. Targeting Ligands: It is desirable to target the oligonucleotides herein (e.g., a ds oligonucleotide) to one or more cells or one or more organs. Such a strategy can help to avoid undesirable effects in other organs or to avoid undue loss of the oligonucleotides to cells, tissue, or organs that would not benefit therefrom. Accordingly, the oligonucleotides can be modified to facilitate targeting and/or delivering to a tissue, cell, or organ (e.g., to facilitate delivering the oligonucleotides to the liver). In some embodiments, the oligonucleotides are modified to facilitate delivery of the oligonucleotide to the hepatocytes of the liver. In some embodiments, the oligonucleotides comprise at least one nucleotide (e.g., 1, 2, 3, 4, 5, 6, or more nucleotides) conjugated to one or more targeting ligand(s).

Exemplary targeting ligands include, but are not limited to, a carbohydrate, amino sugar, cholesterol, peptide, polypeptide, protein, or part of a protein (e.g., an antibody or antibody fragment), or lipid. In some embodiments, the targeting ligand is an aptamer. For example, the targeting ligand is an Arg-Gly-Asp (RGD) peptide for targeting tumor vasculature or glioma cells, Cys-Arg-Glu-Lys-Ala (CREKA) peptide for targeting tumor vasculature or stoma, transferrin, lactoferrin, or an aptamer for targeting transferrin receptors expressed on central nervous system (CNS) vasculature, or an anti-epidermal growth factor receptor (EGFR) antibody for targeting EGFR on glioma cells. In certain embodiments, the targeting ligand is one or more GalNAc moieties.

In some embodiments, 1 or more (e.g., 1, 2, 3, 4, 5, or 6) nucleotides of the oligonucleotides each can be conjugated to a separate targeting ligand. In some embodiments, 2 to 4 nucleotides of the oligonucleotides each are conjugated to a separate targeting ligand. In other embodiments, targeting ligands can be conjugated to 2 to 4 nucleotides at either ends of the sense strand or antisense strand (e.g., targeting ligands are conjugated to a 2 to 4 nucleotide overhang or extension on the 5' or 3' end of the sense strand or antisense strand) such that the targeting ligands resemble bristles of a toothbrush, and the oligonucleotides resemble a toothbrush. For example, the oligonucleotides comprise a stem-loop at either the 5' or 3' end of the sense strand and 1, 2, 3, or 4 nucleotides of the loop of the stem may be individually conjugated to a targeting ligand. In some embodiments, the oligonucleotides comprise a stem-loop at the 3' end of the sense strand, where the loop of the stem-loop includes a triL or a L, and where the 3 or 4 nucleotides of the triL or L, respectfully, are individually conjugated to a targeting ligand.

GalNAc is a high affinity ligand for the ASGPR, which is primarily expressed on the sinusoidal surface of hepatocyte cells and has a major role in binding, internalizing and subsequent clearing circulating glycoproteins that contain terminal galactose or GalNAc residues (asialoglycoproteins). Conjugation (either indirect or direct) of GalNAc moieties to the oligonucleotides herein are used to target them to the ASGPR expressed on cells. In some embodiments, the oligonucleotides are conjugated to at least one or more GalNAc moieties, where the GalNAc moieties target the oligonucleotides to an ASGPR expressed on human liver cells (e.g., human hepatocytes).

The oligonucleotides are conjugated directly or indirectly to a monovalent GalNAc. In some embodiments, the oligonucleotides are conjugated directly or indirectly to more than 1 monovalent GalNAc (i.e., is conjugated to 2, 3, or 4 monovalent GalNAc moieties, and is typically conjugated to 3 or 4 monovalent GalNAc moieties). In some embodiments, the oligonucleotides are conjugated to one or more bivalent GalNAc, trivalent GalNAc or tetravalent GalNAc moieties.

In some embodiments, 1 or more (e.g., 1, 2, 3, 4, 5, or 6) nucleotides of the oligonucleotides each can be conjugated to a GalNAc moiety. In some embodiments, 2 to 4 nucleotides of a L each are conjugated to a separate GalNAc. In other embodiments, 1 to 3 nucleotides of a triL each are conjugated to a separate GalNAc. In some embodiments, the targeting ligands are conjugated to 2 to 4 nucleotides at either end of the sense or antisense strand (e.g., ligands are conjugated to a 2 to 4 nucleotide overhang or extension on the 5' or 3' end of the sense or antisense strand) such that the GalNAc moieties resemble bristles of a toothbrush, and the oligonucleotides resemble a toothbrush. In some embodiments, the GalNAc moieties are conjugated to a nucleotide of the sense strand. For example, 4 GalNAc moieties are conjugated to nucleotides in the L of the sense strand, where each GalNAc moiety is conjugated to 1 nucleotide. In certain embodiments, 3 GalNAc moieties are conjugated to nucleotides in the L of the sense strand, where each GalNAc moiety is conjugated to 1 nucleotide.

In certain embodiments, the oligonucleotides comprise a monovalent GalNAc attached to a guanine nucleotide referred to as [ademG-GalNAc] or 2'-aminodiethoxymethanol-Guanine-GalNAc, as depicted below:

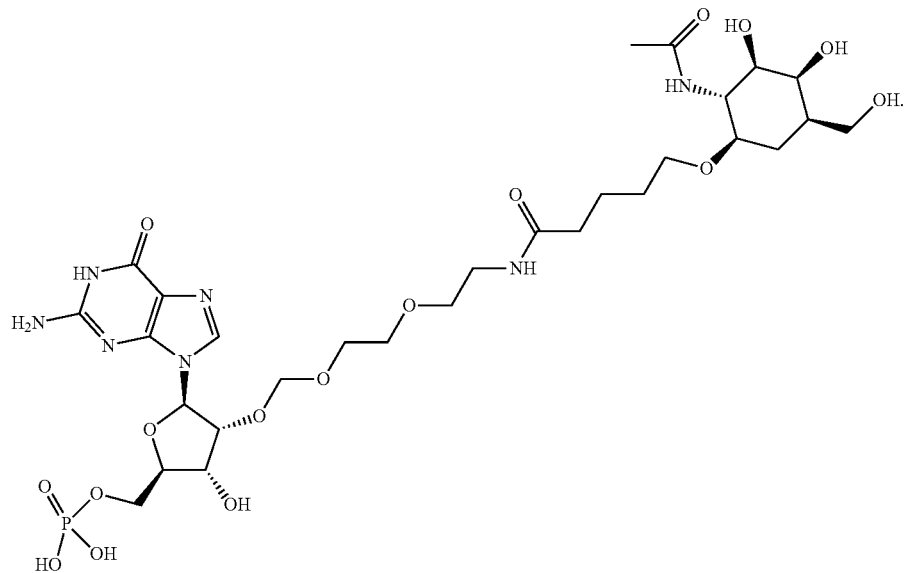 [SMILES: CC(=O)N[C@@H]1[C@@H](O)[C@@H](O)[C@@H](CO)C[C@H]1OCCCCC(=O)NCCOCCOCO[C@@H]1[C@H](O)[C@@H](COP(=O)(O)O)O[C@H]1n1cnc2c(=O)[nH]c(N)nc21]

In certain embodiments, the oligonucleotides herein comprise a monovalent GalNAc attached to an adenine nucleotide, referred to as [ademA-GalNAc] or 2'-aminodiethoxymethanol-Adenine-GalNAc, as depicted below:

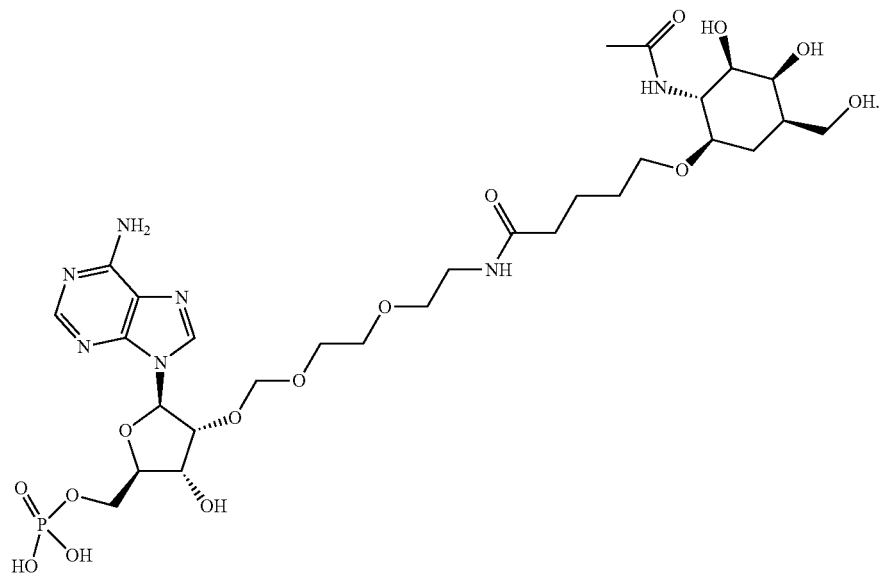 [SMILES: CC(=O)N[C@@H]1[C@@H](O)[C@@H](O)[C@@H](CO)C[C@H]1OCCCCC(=O)NCCOCCOCO[C@@H]1[C@H](O)[C@@H](COP(=O)(O)O)O[C@H]1n1cnc2c(N)ncnc21]

In certain embodiments, the oligonucleotides comprise a monovalent 2'-GalNAc attached to a guanine nucleotide referred to as [prgG-peg-GalNAc] wherein N-Acetylgalactosamine (GalNAc) is conjugated to guanine via polyethylene glycol and propargyl (alkyne) linker, as depicted below:

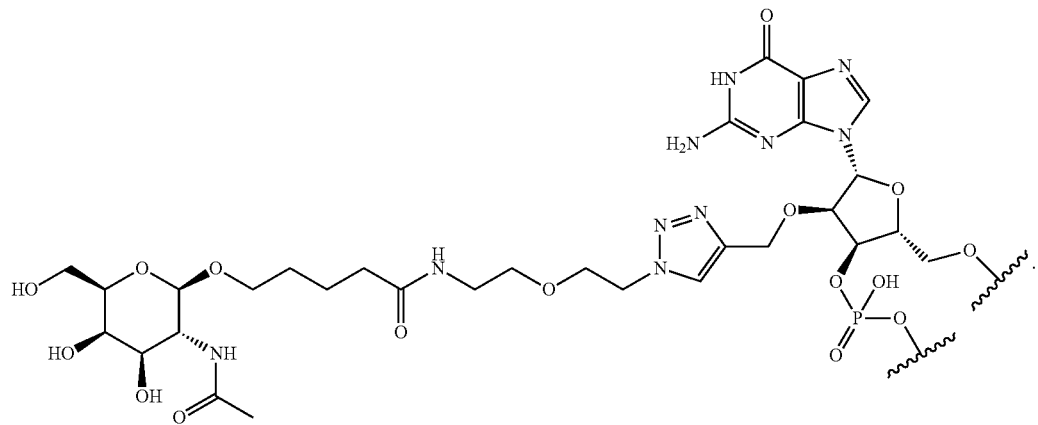 [SMILES: *OC[C@H]1O[C@@H](n2cnc3c(=O)[nH]c(N)nc32)[C@H](OCc2cn(CCOCCNC(=O)CCCCO[C@@H]3O[C@H](CO)[C@H](O)[C@H](O)[C@H]3NC(C)=O)nn2)[C@@H]1OP(=O)(O)O*]

In certain embodiments, the oligonucleotides herein comprise a monovalent 2'-GalNAc attached to an adenine nucleotide, referred to as [prgA-peg-GalNAc] wherein N-Acetylgalactosamine (GalNAc) is conjugated to adenine via polyethylene glycol and propargyl (alkyne) linker, as depicted below:

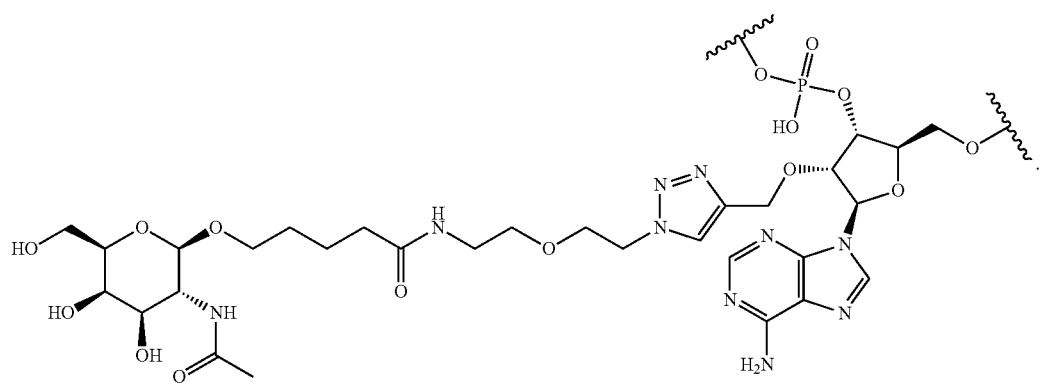 [SMILES: *OC[C@H]1O[C@@H](n2cnc3c(N)ncnc32)[C@H](OCc2cn(CCOCCNC(=O)CCCCO[C@@H]3O[C@H](CO)[C@H](O)[C@H](O)[C@H]3NC(C)=O)nn2)[C@@H]1OP(=O)(O)O*]

An example of such conjugation is shown below for a loop having from 5' to 3', the nucleotide sequence GAAA (L=linker, X=heteroatom), where stem attachment points are shown. Such a loop is present, for example, at positions 27-30 of the sense strand listed in Table 4 and as shown in FIG. 1. In the chemical formula,

is used to describe an attachment point to the oligonucleotide strand:

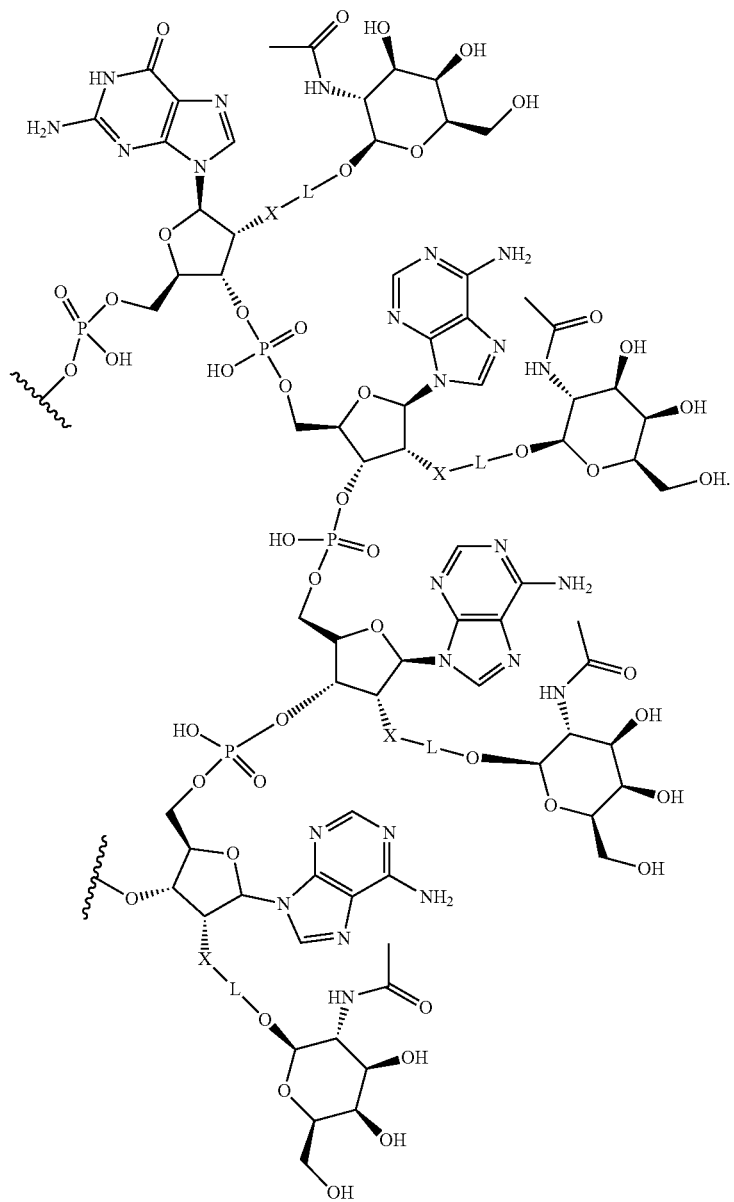

Appropriate methods or chemistry (e.g., click chemistry) are used to link a targeting ligand to a nucleotide. One way of conjugating the targeting ligand to a nucleotide is by using a click linker. In some embodiments, an acetal-based linker is used to conjugate the targeting ligand to a nucleotide of any one of the oligonucleotides herein. Acetal-based linkers are disclosed, for example, in Intl. Patent Application Publication No. WO 2016/100401. In some embodiments, the linker is a labile linker. However, in other embodiments, the linker is stable. An example is shown below for a loop having from 5' to 3', the nucleotides GAAA, in which GalNAc moieties are attached to nucleotides of the loop using an acetal linker. Such a loop is present, for example, at positions 27-30 of the any one of the sense strands listed in Tables 2 or 3. In the chemical formula,

is an attachment point to the oligonucleotide strand:

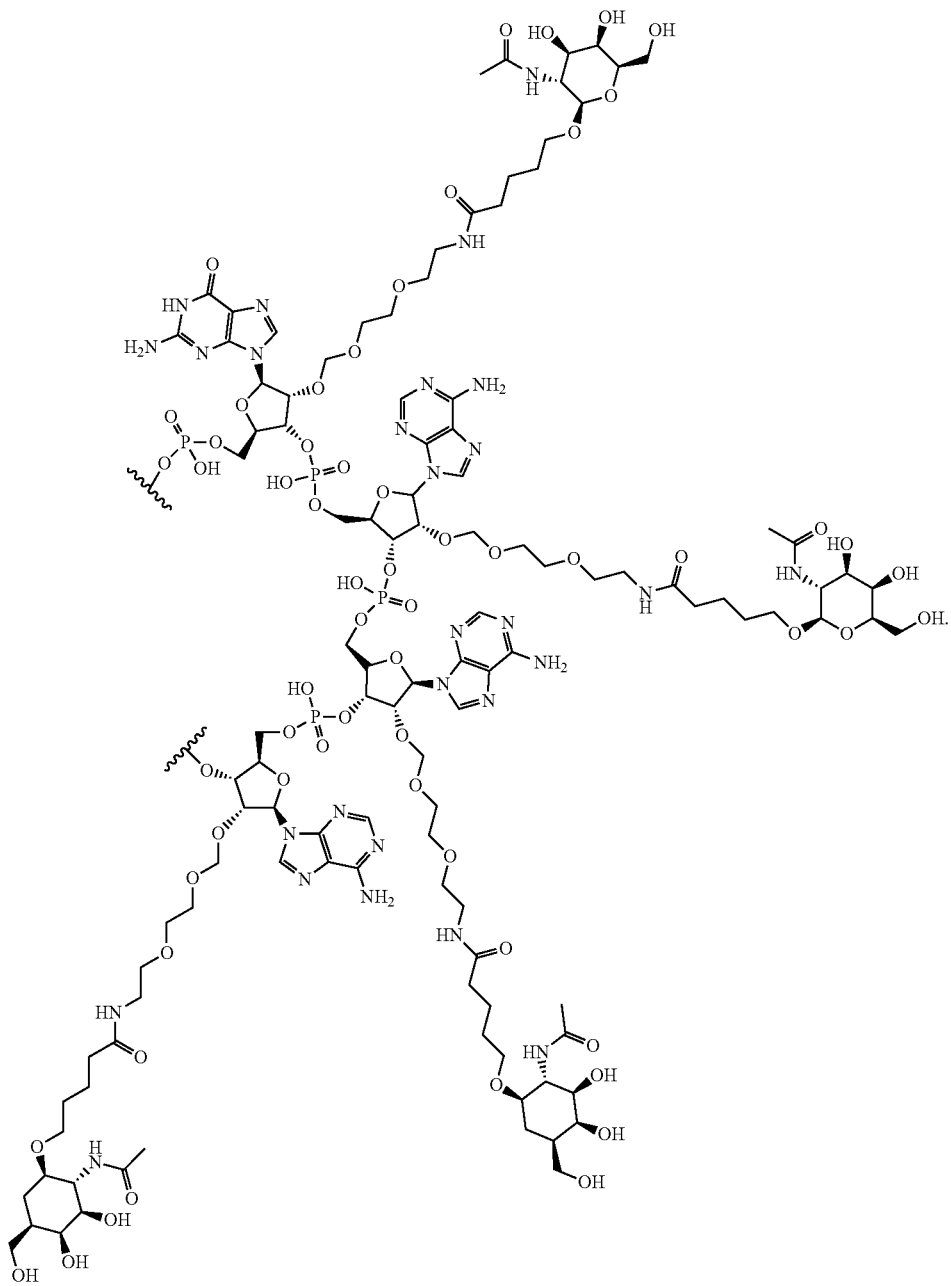

In some embodiments, a duplex extension (e.g., of up to 3, 4, 5, or 6 bp in length) is provided between the targeting ligand (e.g., a GalNAc moiety), and the oligonucleotides herein (e.g., a ds oligonucleotide). In other embodiments, the oligonucleotides do not have a GalNAc conjugated thereto.

Formulations and Pharmaceutical Compositions

The oligonucleotides herein (e.g., a ds oligonucleotide), or a pharmaceutically acceptable salt thereof (e.g., trifluoroacetate salts, acetate salts or hydrochloride salts), are incorporated into a formulation or pharmaceutical composition. Various formulations have been developed to facilitate oligonucleotide use. For example, oligonucleotides can be delivered to an individual or a cellular environment using a formulation that minimizes degradation, facilitates delivery and/or uptake, or provides another beneficial property to the oligonucleotides in the formulation. In some embodiments, the oligonucleotides are formulated in buffer solutions such as phosphate buffered saline solutions, liposomes, micellar structures, and capsids.

To improve in vivo compatibility and effectiveness, the oligonucleotides may be reacted with any of a number of inorganic and organic acids/bases to form pharmaceutically acceptable acid/base addition salts. Pharmaceutically acceptable salts and common methodologies for preparing them are well known in the art (see, e.g., Stahl et al., "Handbook of Pharmaceutical Salts: Properties, Selection and Use," $2^{nd}$ Revised Edition (Wiley-VCH, 2011)). Pharmaceutically acceptable salts for use herein include sodium, trifluoroacetate, hydrochloride and acetate salts.

Formulations of oligonucleotides with cationic lipids are used to facilitate transfection of the oligonucleotides into cells. For example, cationic lipids, such as lipofectin, cationic glycerol derivatives, and polycationic molecules (e.g., polylysine) can be used. Suitable lipids include OLIGOFECTAMINE™ Transfection Reagent (ThermoFisher Technologies), LIPOFECTAMINE™ Transfection Reagent (Life Technologies), NC388 (Ribozyme Pharmaceuticals, Inc.), or FUGENE™ 6 Transfection Reagent (Roche), all of which are used according to the manufacturer's instructions.

Accordingly, in some embodiments, the formulations herein comprise a liposome, a lipid, a lipid complex, a microsphere, a microparticle, a nanosphere, or a nanoparticle (such as a lipid nanoparticle) or may be otherwise formulated for administration to the cells, tissues, organs, or body of an individual in need thereof (see, e.g., Remington, "The Science and Practice of Pharmacy" (L. V. Allen Jr., ed., $22^{nd}$ Edition, Pharmaceutical Press, 2013).

In some embodiments, the formulations herein further comprise an excipient, which can confer to a composition improved stability, improved absorption, improved solubility and/or therapeutic enhancement of the active ingredient. In some embodiments, the excipient is a buffering agent (e.g., sodium citrate, sodium phosphate, a tris base, or sodium hydroxide) or a vehicle (e.g., a buffered solution, petrolatum, dimethyl sulfoxide, or mineral oil). In some embodiments, the oligonucleotides herein are lyophilized for extending shelf-life and then made into a solution before use (e.g., administration to an individual). Accordingly, the excipient in a pharmaceutical composition including one or more of the oligonucleotides is a lyoprotectant (e.g., mannitol, lactose, polyethylene glycol, or polyvinylpyrrolidone) or a collapse temperature modifier (e.g., dextran, Ficoll™, or gelatin).

Pharmaceutical compositions are formulated to be compatible with its intended route of administration. Routes of administration include, but are not limited to, parenteral (e.g., intravenous, intramuscular, intraperitoneal, intradermal, and subcutaneous), oral (e.g., inhalation), transdermal (e.g., topical), transmucosal, and rectal administration.

Pharmaceutical compositions suitable for injectable use comprise sterile aqueous solutions (where water soluble) or dispersions and sterile powders for the extemporaneous preparation of sterile injectable solutions or dispersion. For intravenous administration, suitable carriers include, but are not limited to, physiological saline, bacteriostatic water, Cremophor EL™ (BASF) or phosphate buffered saline (PBS). The carrier is a solvent or dispersion medium containing, for example, water, ethanol, polyol (e.g., glycerol, propylene glycol, liquid polyethylene glycol, and the like), as well as suitable mixtures thereof. In many embodiments, it will be preferable to comprise in the compositions with isotonic agents such as, for example, sugars, polyalcohols such as mannitol, sorbitol and/or sodium chloride. Sterile injectable solutions are prepared by incorporating the oligonucleotides herein in a required amount in a selected solvent with one or a combination of ingredients enumerated above, as required, followed by filtered sterilization.

Moreover, the pharmaceutical compositions comprise at least about 0.1% of a therapeutic agent (e.g., one or more of the oligonucleotides herein) or more, although the percentage of the therapeutic agent may be between about 1% to about 80% or more of the weight or volume of the total composition. Factors such as solubility, bioavailability, biological half-life, route of administration, product shelf life, as well as other pharmacological considerations will be contemplated by one of skill in the art of preparing such pharmaceutical formulations, and as such, a variety of dosages and treatment regimens may be desirable.

Even though several examples are directed toward liver-targeted delivery of at least one of the oligonucleotides herein, targeting of other tissues also is contemplated.

Kits

The oligonucleotides herein (e.g., ads oligonucleotide) can be incorporated into a kit comprising one or more of the oligonucleotides herein, and instructions for use. In some embodiments, the kit comprises one or more of the oligonucleotides, and a package insert containing instructions for use of the kit and/or any component thereof. In other embodiments, the kit comprises a suitable container, one or more of the oligonucleotides, one or more controls, and various buffers, reagents, enzymes, and other standard ingredients as are known in the art.

In some embodiments, the container can be at least one vial, well, test tube, flask, bottle, syringe, or other container means, into which the one or more oligonucleotides are placed, and in some embodiments, suitably aliquoted. In other embodiments, where an additional component is provided, the kit contains additional containers into which this component is placed. The kit also comprises a means for containing the one or more oligonucleotides and any other reagent in close confinement for commercial sale. Such containers include injection or blow-molded plastic containers into which the desired vials are retained. Containers and/or kits comprise labeling with instructions for use and/or warnings.

In some embodiments, the kit comprises one or more oligonucleotides herein, and a pharmaceutically acceptable carrier, or a pharmaceutical composition comprising one or more of the oligonucleotides and instructions for treating or delaying progression of a disease, disorder, or condition associated with APOC3 expression in an individual in need thereof.

Methods

Methods of Making

The oligonucleotides herein (e.g., a ds oligonucleotide) are made using methods and/or techniques known to one of skill in the art such as, for example, conventional nucleic acid solid phase synthesis. The polynucleotides of the oligonucleotides are assembled on a suitable nucleic acid synthesizer utilizing standard nucleotide or nucleoside precursors (e.g., phosphoramidites). Automated nucleic acid synthesizers, including DNA/RNA synthesizers, are commercially available from, for example, Applied Biosystems (Foster City, CA), BioAutomation (Irving, TX), and GE Healthcare Life Sciences (Pittsburgh, PA).

As one of skill in the art understands, other methods and/or techniques of synthesizing the oligonucleotides herein are used. Additionally, the various synthetic steps are performed in an alternate sequence or order to give the desired compounds. Other synthetic chemistry transformations, protecting groups (e.g., for hydroxyl, amino, etc. present on the bases), and protecting group methodologies (protection and deprotection) useful in synthesizing the oligonucleotides are known in the art and are described in, for example, Larock, "Comprehensive Organic Transformations," VCH Publishers (1989); Greene & Wuts, PROTECTIVE GROUPS IN ORGANIC SYNTHESIS, $2^{nd}$ Ed., John Wiley & Sons (1991); Fieser & Fieser, *Fieser and Fieser's Reagents for Organic Synthesis*, John Wiley & Sons (1994); and Paquette, ed., ENCYCLOPEDIA OF REAGENTS FOR ORGANIC SYNTHESIS, John Wiley & Sons (1995).

Methods of Using

I. Methods of Reducing APOC3 Expression in Cells, Tissue, Organs, and Organisms: The oligonucleotides herein (e.g., a ds oligonucleotide) are used to reduce APOC3 mRNA in cells, tissues, organs, or individuals. The methods comprise the steps described herein, and these may be, but not necessarily, carried out in the sequence as described. Other sequences, however, also are conceivable. Moreover, individual, or multiple steps are carried out either in parallel and/or overlapping in time and/or individually or in multiply repeated steps. Furthermore, the methods comprise additional, unspecified steps.

The methods comprise contacting or delivering to a cell, population of cells, tissues, organs, or individuals an effective amount any of the oligonucleotides herein for reducing APOC3 expression. In some embodiments, reduced APOCA3 expression is determined by measuring a reduction in the amount or level of APOC3 mRNA, APOC3 protein, or APOC3 activity in a cell.

With regard to an appropriate cell type, the cell type is any cell that expresses mRNA (e.g., hepatocytes, macrophages, monocyte-derived cells, prostate cancer cells, cells of the brain, endocrine tissue, bone marrow, lymph nodes, lung, gall bladder, liver, duodenum, small intestine, pancreas, kidney, gastrointestinal tract, bladder, adipose and soft tissue, and skin). In some embodiments, the cell is a primary cell obtained from an individual. In some embodiments, the primary cell has undergone a limited number of passages such that the cell substantially maintains is natural phenotypic properties. In some embodiments, the cell is an ex vivo, in vivo, or in vitro cell (i.e., such that one or more of the oligonucleotides herein can be delivered to the cell in culture or to an organism in which the cell resides).

In some embodiments, the oligonucleotides herein are delivered to a cell or population of cells using a nucleic acid delivery method known in the art including, but not limited to, injecting a solution containing the oligonucleotides, bombarding by particles covered by the oligonucleotides, exposing the cell or population of cells to a solution containing the oligonucleotides, or electroporating cell membranes in the presence of the oligonucleotides. Other methods known in the art for delivering oligonucleotides to cells are used such as, for example, lipid-mediated carrier transport, chemical-mediated transport, and cationic liposome transfection such as calcium phosphate, and others.

Reduced APOC3 expression is determined by an assay or technique that evaluates one or more molecules, properties or characteristics of a cell or population of cells associated with APOC3 expression (e.g., using an APOC3 expression biomarker) or by an assay or technique that evaluates molecules that are directly indicative of APOC3 expression in a cell or population of cells (e.g., APOC3 mRNA or APOC3 protein). In some embodiments, the extent to which the oligonucleotides reduce APOC3 expression are evaluated by comparing APOC3 expression in a cell or population of cells contacted with the oligonucleotides to a control cell or population of cells (e.g., a cell or population of cells not contacted with the oligonucleotides or contacted with a control oligonucleotide). In some embodiments, a control amount or level of APOC3 expression in a control cell or population of cells is predetermined, such that the control amount or level need not be measured in every instance the assay or technique is performed. The predetermined level or value takes a variety of forms including, but not limited to, a single cut-off value, such as a median or mean.

Contacting or delivering the oligonucleotides herein to a cell or a population of cells result in reduced APOC3 expression. In some embodiments, reduced APOC3 expression is relative to a control amount or level of APOC3 expression in the cell or the population of cells not contacted with the oligonucleotides or contacted with a control oligonucleotide. In some embodiments, reduced APOC3 expression is about 10% or lower, about 5% or lower, about 10% or lower, about 15% or lower, about 20% or lower, about 25% or lower, about 30% or lower, about 35% or lower, about 40% or lower, about 45% or lower, about 50% or lower, about 55% or lower, about 60% or lower, about 70% or lower, about 80% or lower, or about 90% or lower relative to a control amount or level of APOC3 expression. In some embodiments, the control amount or level of APOC3 expression is an amount or level of APOC3 mRNA and/or APOC3 protein in the cell or the population of cells that has not been contacted with oligonucleotides herein. In some embodiments, the effect of delivery of the oligonucleotides to the cell or the population of cells according to a method herein is assessed after any finite period or amount of time (e.g., minutes, hours, days, weeks, and/or months). For example, APOC3 expression is determined in the cell or the population of cells at least about 4 hours, about 8 hours, about 12 hours, about 18 hours, or about 24 hours. Alternatively, APOC3 expression is determined in the cell or the population of cells at least about 1 day, about 2 days, about 3 days, about 4 days, about 5 days, about 6 days, about 7 days, about 8 days, about 9 days, about 10 days, about 11 days, about 12 days, about 13 days, about 14 days, about 21 days, about 28 days, about 35 days, about 42 days, about 49 days, about 56 days, about 63 days, about 70 days, about 77 days, or about 84 days or more after contacting or delivering the oligonucleotides to the cell or population of cells. In other embodiments, APOC3 expression is determined in the cell or the population of cells at least about 1 month, about 2 months, about 3 months, about 4 months, about 5 months, or about 6 months or more after contacting or delivering the oligonucleotides to the cell or the population of cells.

In some embodiments, the oligonucleotides herein are delivered in the form of a transgene that is engineered to express in a cell one or more of the oligonucleotides or strands (e.g., sense and antisense strands). For example, the oligonucleotides are delivered using a transgene engineered to express any oligonucleotide herein. Transgenes may be delivered using viral vectors (e.g., adenovirus, retrovirus, vaccinia virus, poxvirus, adeno-associated virus, or herpes simplex virus) or non-viral vectors (e.g., plasmids or synthetic mRNAs). In some embodiments, the transgenes are injected directly to an individual.

II. Methods of Treatment: Methods of treating an individual having, suspected of having or at risk of developing, a disease, disorder, or condition associated with APOC3 expression comprise administering at least one or more of the oligonucleotides herein (e.g., a ds oligonucleotide) to the individual. Additionally, methods of treating or attenuating an onset or progression of a disease, disorder, or condition associated with APOC3 expression in an individual comprise using one or more of the oligonucleotides herein. Furthermore, methods of achieving one or more therapeutic benefits in an individual having a disease, disorder, or condition associated with APOC3 expression comprise providing one or more of the oligonucleotides herein. In some embodiments, the individual can be treated by administering a therapeutically effective amount of any one or more of the oligonucleotides herein. In some embodiments, the treatment comprises reducing APOC3 expression. In some embodiments, the individual is treated therapeutically. In some embodiments, the individual is treated prophylactically. In all these embodiments, the oligonucleotide is selected from Table 3.

In some embodiments, the one or more oligonucleotides, or a pharmaceutical composition including the same, is administered to the individual having a disease, disorder, or condition associated with APOC3 expression such that APOC3 expression is reduced in the individual, thereby treating the individual. In some embodiments, an amount or level of APOC3 mRNA is reduced in the individual. In other embodiments, an amount or level of APOC3 protein is reduced in the individual. In still other embodiments, an amount or level of APOC3 activity is reduced in the individual. In yet other embodiments, an amount or level of liver TG (e.g., one or more TG(s) or total TGs in liver) is reduced in the individual, especially in the liver. In still other embodiments, an amount or level of liver inflammation can be reduced. In still other embodiments, an amount of level of liver fibrosis is reduced. In still other embodiments, an amount or level of plasma aspartate aminotransferase (AST), plasma alanine aminotransferase (ALT), Cytokeratin 18 (CK-18), or even N-terminal type III collagen propeptide (Pro-C3) is reduced. In any of the above disclosed embodiments, the oligonucleotides comprise a sense strand having a nucleotide sequence of any one of SEQ ID NOs:143, 149, 151, 193, 195, 205, 207 and 211, and an antisense strand having a nucleotide sequence of any one of SEQ ID NOs: 144, 150, 152, 194, 196, 206, 208 and 212.

In some embodiments, APOC3 expression is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to APOC3 expression prior to administering the one or more oligonucleotides or pharmaceutical composition thereof. In other embodiments, APOC3 expression is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to APOC3 expression in an individual (e.g., a reference or control individual) not receiving the one or more oligonucleotides or pharmaceutical composition or receiving a control oligonucleotide, pharmaceutical composition or treatment.

In certain embodiments, an amount or level of APOC3 mRNA is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of APOC3 mRNA prior to administering the one or more oligonucleotides or pharmaceutical composition thereof. In some embodiments, the amount or level of APOC3 mRNA is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of APOC3 mRNA in an individual (e.g., a reference or control individual) not administered the one or more oligonucleotides or pharmaceutical composition or administered a control oligonucleotide, pharmaceutical composition, or treatment.

In certain embodiments, an amount or level of APOC3 protein is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of APOC3 protein prior to administering the one or more oligonucleotides or pharmaceutical composition thereof. In other embodiments, an amount or level of APOC3 protein is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of APOC3 protein in an individual (e.g., a reference or control individual) not administered the one or more oligonucleotides or pharmaceutical composition or administered a control oligonucleotide, pharmaceutical composition or treatment.

In certain embodiments, an amount or level of APOC3 activity is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of APOC3 activity prior to administering the one or more oligonucleotides or pharmaceutical composition thereof. In some embodiments, the amount or level of APOC3 activity is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of APOC3 activity in an individual (e.g., a reference or control individual) not administered the one or more oligonucleotides or pharmaceutical composition or administered a control oligonucleotide, pharmaceutical composition or treatment.

In certain embodiments, an amount or level of TG, especially liver TG, can be reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of TG prior to administering the one or more oligonucleotides or pharmaceutical composition thereof. In some embodiments, the amount or level of TG is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of TG in an individual (e.g., a reference or control individual) not administered the one or more oligonucleotides or pharmaceutical composition or administered a control oligonucleotide, pharmaceutical composition or treatment.

Here, APOC3 expression, the amount or level of APOC3 mRNA, APOC3 protein, APOC3 activity, liver TG, or any combination thereof, is reduced in a cell (e.g., a hepatocyte), a population or a group of cells (e.g., an organoid), a tissue (e.g., liver tissue), a sample (e.g., a liver biopsy sample), an organ (e.g., liver), blood or a fraction thereof (e.g., plasma), or any other biological material obtained or isolated from the individual. In some embodiments, APOC3 expression, the amount or level of APOC3 mRNA, APOC3 protein, APOC3 activity, TG, or any combination thereof, is reduced in more than one type of cell (e.g., a hepatocyte and one or more other type(s) of cell), more than one groups of cells, more than one type of tissue (e.g., liver tissue and one or more other type(s) of tissue), more than one type of sample (e.g., a liver biopsy sample and one or more other type(s) of biopsy sample), more than one organ (e.g., liver and one or more other organ(s)), more than one fraction of blood (e.g., plasma and one or more other blood fraction(s)) obtained or isolated from the individual.

Examples of a disease, disorder, or condition associated with APOC3 expression include, but are not limited to, ACD, AH, ALD, ASCVD, HCC, CHD, CCA, PSC, MetS, NAFLD, NASH, high non-HDL cholesterol, hyperlipidemia, hypertriglyceridemia, diabetes, obesity, fatty liver (steatosis), inflammation of the liver, insulin resistance, liver fibrosis, cirrhosis of the liver, or a combination thereof.

Because of their high specificity, the oligonucleotides herein specifically target mRNAs of target genes of cells, tissues, or organs (e.g., liver). In preventing disease, the target gene is the one that is required for initiation or maintenance of the disease or that has been identified as being associated with a higher risk of contracting the disease. In treating disease, one or more of the oligonucleotides herein are brought into contact with the cells, tissue or organ exhibiting or responsible for mediating the disease. For example, an oligonucleotide substantially identical to all or part of a wild-type (i.e., native) or mutated gene associated with a disorder or condition associated with APOC3 expression is brought into contact with or introduced into a cell or tissue type of interest such as a hepatocyte or other liver cell.

In some embodiments, the target gene is from any mammal, such as a human. Any gene may be silenced according to the methods herein. Moreover, the methods herein typically involve administering to an individual a therapeutically effective amount of one or more oligonucleotides herein, that is, an amount capable of producing a desirable therapeutic result. The therapeutically acceptable amount is an amount that therapeutically treats a disease or disorder or condition. The appropriate dosage for any one individual will depend on certain factors, including the individual's size, body surface area, age, the composition to be administered, the active ingredient(s) in the composition, time and route of administration, general health, and other therapeutic agents being administered concurrently.

In the methods, the individual is administered any one of the oligonucleotides or compositions herein either enterally (e.g., orally, by gastric feeding tube, by duodenal feeding tube, via gastrostomy, or rectally), parenterally (e.g., subcutaneous injection, intravenous injection or infusion, intra-arterial injection or infusion, intraosseous infusion, intramuscular injection, intracerebral injection, intracerebroventricular injection, or intrathecal), topically (e.g., epicutaneous, inhalational, via eye drops, or through a mucous membrane), or by direct injection into a target organ (e.g., the liver of an individual). Typically, the oligonucleotides or compositions are administered intravenously or subcutaneously.

As a non-limiting set of examples, the oligonucleotides or compositions herein typically are administered quarterly (once every three months), bi-monthly (once every two months), monthly or weekly. For example, the oligonucleotides or compositions are administered every week or at intervals of two, or three weeks. In certain embodiments, the oligonucleotides, or compositions are administered daily. In some embodiments, an individual is administered one or more loading doses of the oligonucleotides or compositions followed by one or more maintenance doses of the oligonucleotides or compositions.

In some embodiments, the individual is a human, a NHP, or other mammalian individual. In other embodiments, the individual is a domesticated animal such as a dog or a cats; livestock such as a horse, cattle, pig, sheep, goat, or chicken; and animals such as a mouse, rat, guinea pig or hamster.

III. Medical Uses: The oligonucleotides herein (e.g., a ds oligonucleotide) can be used, or adapted for use, to treat an individual (e.g., a human having a disease, disorder, or condition associated with APOC3 expression) that would benefit from reducing APOC3 expression. In some embodiments, the oligonucleotides are provided for use, or adapted for use, to treat an individual having a disease, disorder, or condition associated with APOC3 expression. Also, the oligonucleotides are provided for use, or adaptable for use, in the manufacture of a medicament or pharmaceutical composition for treating a disease, disorder, or condition associated with APOC3 expression. In other embodiments, the oligonucleotides are provided for use, or adaptable for use, in targeting APOC3 mRNA and reducing APOC3 expression (e.g., via the RNAi pathway). In other embodiments, the oligonucleotides are provided for use, or adaptable for use, in targeting APOC3 mRNA and reducing an amount or level of APOC3 mRNA, APOC3 protein, and/or APOC3 activity.

In some embodiments, the methods comprise selecting an individual for treatment based upon the individual having a marker (e.g., a biomarker) for a disease, disorder, or condition associated with APOC3 expression, or someone predisposed to the same, such as, but not limited to, APOC3 mRNA, APOC3 protein or a combination thereof. Likewise, and as detailed below, the methods also comprise additional steps such as, for example, measuring or obtaining a baseline value for a marker of APOC3 expression (e.g., APOC3 protein) and then comparing such obtained value to one or more other baseline values or values obtained after the individual is administered one or more of the oligonucleotides to assess the effectiveness of treatment.

EXAMPLES

The following non-limiting examples are offered for purposes of illustration, not limitation.

Synthesis of Oligonucleotides

Example 1: Preparing ds RNAi Oligonucleotides

Oligonucleotide synthesizing and purifying: The ds RNAi oligonucleotides in the Examples are chemically synthesized using methods described herein. Generally, ds RNAi oligonucleotides are synthesized using solid phase oligonucleotide synthesis methods as described for 19-23mer siRNAs (see, e.g., Scaringe et al. (1990) NUCLEIC ACIDS RES. 18:5433-41 and Usman et al. (1987) J. AM. CHEM. SOC. 109:7845-45; see also, U.S. Pat. Nos. 5,804,683; 5,831,071; 5,998,203; 6,008,400; 6,111,086; 6,117,657; 6,353,098; 6,362,323; 6,437,117 and 6,469,158).

Individual RNA strands are synthesized and HPLC purified according to standard methods (Integrated DNA Technologies). For example, RNA oligonucleotides are synthesized using solid phase phosphoramidite chemistry, deprotected, and desalted on NAP-5 columns (Amersham Pharmacia Biotech; Piscataway, NJ) using standard techniques (Damha & Olgivie (1993) METHODS MOL. BIOL. 20:81-114; Wincott et al. (1995) NUCLEIC ACIDS RES. 23:2677-84). The oligomers are purified using ion-exchange high performance liquid chromatography (IE-HPLC) on an Amersham Source 15Q column (1.0 cm×25 cm; Amersham Pharmacia Biotech) using a 15 min step-linear gradient. The gradient varies from 90:10 Buffers A:B to 52:48 Buffers A:B, where Buffer A is 100 mM Tris pH 8.5 and Buffer B is 100 mM Tris pH 8.5, 1 M NaCl. Samples are monitored at 260 nm and peaks corresponding to the full-length oligonucleotide species are collected, pooled, desalted on NAP-5 columns, and lyophilized.

The purity of each oligomer is determined by capillary electrophoresis (CE) on a Beckman PACE 5000 (Beckman Coulter, Inc.). The CE capillaries have a 100 µm inner diameter and contain ssDNA 100R Gel (Beckman-Coulter). Typically, about 0.6 nmole of oligonucleotide is injected into a capillary, is run in an electric field of 444 V/cm, and is detected by UV absorbance at 260 nm. Denaturing Tris-Borate-7 M-urea running buffer is purchased from Beckman-Coulter. Oligoribonucleotides are obtained that are at least 90% pure as assessed by CE for use in experiments described below. Compound identity is verified by matrix-assisted laser desorption ionization time-of-flight (MALDI-TOF) mass spectroscopy on a Voyager DE™ Biospectometry Work Station (Applied Biosystems) following the manufacturer's recommended protocol. Relative molecular masses of all oligomers are obtained, often within 0.2% of expected molecular mass.

Preparing duplexes: ss RNA oligomers are resuspended (e.g., at 100 µM concentration) in duplex buffer having 100 mM potassium acetate, 30 mM HEPES, pH 7.5. Complementary sense and antisense strands are mixed in equal molar amounts to yield a final solution of, for example, 50 µM duplex. Samples are heated to 100° C. for 5 min in RNA buffer (IDT) and are allowed to cool to room temperature before use. The ds RNA oligonucleotides are stored at −20° C. ss RNA oligomers are stored lyophilized or in nuclease-free water at −80° C.

In Vitro Function

Example 2: RNAi Oligonucleotide Inhibition of APCO3 Expression In Vitro-DsiRNA-Based Compounds APOC3 target sequence identifying: To identify RNAi oligonucleotide inhibitors of APOC3 expression, a computer-based algorithm is used to computationally generate APOC3 target sequences suitable for assaying APOC3 expression inhibition by the RNAi pathway. The algorithm provides RNAi oligonucleotide antisense (guide) strand sequences that are complementary to suitable APOC3 target sequences of human APOC3 mRNA (e.g., SEQ ID NO:1). Some of the antisense strand sequences identified by the algorithm also are complementary to the corresponding APOC3 target sequence of NHP APOC3 mRNA (e.g., monkey, SEQ ID NO:5). From this, 384 ds RNAi oligonucleotides (formatted as DsiRNA oligonucleotides) are generated, each with a unique antisense strand having a region of complementarity to a APOC3 target sequence identified by the algorithm.

In vitro cell-based assays: The ability of each of the 384 DsiRNAs to inhibit APOC3 expression is determined via in vitro cell-based assays. Further, and as shown herein, the nucleotide sequences for the passenger strand and guide strand of the DsiRNAs a distinct pattern of modified nucleotides and phosphorothioate linkages. Briefly, Hep G2 cells stably expressing APOC3 are transfected with each of the DsiRNAs (0.5 nM) in separate wells of a multi-well cell culture plate. Cells are maintained for 24 hr following transfection, and then levels of remaining APOC3 mRNA from the transfected cells are determined using TAQMAN®-based qPCR assays. Two qPCR assays, a 3' assay and a 5' assay, are used to determine mRNA levels as measured by HEX probes.

The results of the Hep G2 cell-based assay with the 384 DsiRNAs are shown in Table 1, where the 384 DsiRNAs have guide strands that are complementary to human and NHP APOC3 mRNA ("double-common"). Transfection of a double-common DsiRNA that results in less than or equal to 30% APOC3 mRNA remaining in the cells when compared to negative controls is considered a candidate APOC3 expression inhibitor (referred to herein as a "hit").

TABLE 1

Double-Common DsiRNA APOC3 Knockdown in Hep G2 Cells, 0.5 nM 24 hr-5'and -3' Assays % mRNA Remaining (normalized to hSFRS9-F569(HEX) vs Mock Control).

| | APOC3-F149 | |
|---|---|---|
| DsiRNA | % mRNA Remaining | % SEM |
| 1 | 35.2 | 2.5 |
| 2 | 55.3 | 1.7 |
| 3 | 43.3 | 4.4 |
| 4 | 41.7 | 3.2 |
| 5 | 39.7 | 4.5 |
| 6 | 53.0 | 1.2 |
| 7 | 47.0 | 3.0 |
| 8 | 41.3 | 2.5 |
| 9 | 53.8 | 1.5 |
| 10 | 44.2 | 3.8 |
| 11 | 45.0 | 2.2 |
| 12 | 55.1 | 4.8 |
| 13 | 56.1 | 1.1 |
| 14 | 23.3 | 1.3 |
| 15 | 28.3 | 1.3 |
| 16 | 34.9 | 3.6 |
| 17 | 33.3 | 2.2 |
| 18 | 47.3 | 3.2 |
| 19 | 65.4 | 5.6 |
| 20 | 41.0 | 7.1 |
| 21 | 41.6 | 3.1 |
| 22 | 34.3 | 2.4 |
| 23 | 31.0 | 2.0 |
| 24 | 56.9 | 4.4 |
| 25 | 48.9 | 2.3 |
| 26 | 49.7 | 5.7 |
| 27 | 41.4 | 3.5 |
| 28 | 43.3 | 3.9 |
| 29 | 49.6 | 2.0 |
| 30 | 70.3 | 2.2 |
| 31 | 42.0 | 1.7 |
| 32 | 60.0 | 3.6 |
| 33 | 50.8 | 1.5 |
| 34 | 34.3 | 2.0 |
| 35 | 38.5 | 3.8 |
| 36 | 54.0 | 3.3 |
| 37 | 58.9 | 6.4 |
| 38 | 58.9 | 2.8 |
| 39 | 52.1 | 2.4 |
| 40 | 60.3 | 5.2 |
| 41 | 69.0 | 3.0 |
| 42 | 44.7 | 5.5 |
| 43 | 36.8 | 1.8 |
| 44 | 35.5 | 1.5 |
| 45 | 37.4 | 1.7 |
| 46 | 38.1 | 1.4 |
| 47 | 36.9 | 2.8 |
| 48 | 52.4 | 2.1 |
| 49 | 32.1 | 2.2 |
| 50 | 29.8 | 1.5 |
| 51 | 36.5 | 1.9 |
| 52 | 34.9 | 3.5 |
| 53 | 45.9 | 2.4 |
| 54 | 41.8 | 2.5 |
| 55 | 33.5 | 5.6 |
| 56 | 38.6 | 6.6 |
| 57 | 15.7 | 0.9 |
| 58 | 164.0 | 6.1 |
| 59 | 32.1 | 5.2 |
| 60 | 120.3 | 10.1 |

TABLE 1-continued

Double-Common DsiRNA APOC3 Knockdown in Hep G2 Cells, 0.5 nM 24 hr-5'and -3' Assays % mRNA Remaining (normalized to hSFRS9-F569(HEX) vs Mock Control).

| DsiRNA | APOC3-F149 % mRNA Remaining | % SEM |
|---|---|---|
| 61 | 40.4 | 1.9 |
| 62 | 38.2 | 1.6 |
| 63 | 36.1 | 2.6 |
| 64 | 42.0 | 2.2 |
| 65 | 62.1 | 3.6 |
| 66 | 63.0 | 2.1 |
| 67 | 65.9 | 1.8 |
| 68 | 121.6 | 4.4 |
| 69 | 72.6 | 11.2 |
| 70 | 112.5 | 7.2 |
| 71 | 57.3 | 2.9 |
| 72 | 66.1 | 3.8 |
| 73 | 59.7 | 3.5 |
| 74 | 85.9 | 5.3 |
| 75 | 75.5 | 4.3 |
| 76 | 38.6 | 4.1 |
| 77 | 46.4 | 5.9 |
| 78 | 24.7 | 3.6 |
| 79 | 42.0 | 4.3 |
| 80 | 38.5 | 4.1 |
| 81 | 51.8 | 5.2 |
| 82 | 26.7 | 5.7 |
| 83 | 19.5 | 1.3 |
| 84 | 39.0 | 3.8 |
| 85 | 42.6 | 2.7 |
| 86 | 37.4 | 2.8 |
| 87 | 34.4 | 7.4 |
| 88 | 38.4 | 3.0 |
| 89 | 37.9 | 2.2 |
| 90 | 24.9 | 1.0 |
| 91 | 43.4 | 3.0 |
| 92 | 29.6 | 1.8 |
| 93 | 31.8 | 1.5 |
| 94 | 59.1 | 2.6 |
| 95 | 101.6 | 5.0 |
| 96 | 56.7 | 6.9 |
| 97 | 97.6 | 9.6 |
| 98 | 50.3 | 5.3 |
| 99 | 26.0 | 4.8 |
| 100 | 20.8 | 3.5 |
| 101 | 20.4 | 2.2 |
| 102 | 73.0 | 6.0 |
| 103 | 96.4 | 3.3 |
| 104 | 48.3 | 1.9 |
| 105 | 143.5 | 7.0 |
| 106 | 105.8 | 8.6 |
| 107 | 102.9 | 8.7 |
| 108 | 95.5 | 1.3 |
| 109 | 99.7 | 6.7 |
| 110 | 46.6 | 5.2 |
| 111 | 44.2 | 2.5 |
| 112 | 49.4 | 5.5 |
| 113 | 61.3 | 2.9 |
| 114 | 71.5 | 4.3 |
| 115 | 98.0 | 3.9 |
| 116 | 42.2 | 3.8 |
| 117 | 30.8 | 1.0 |
| 118 | 40.2 | 3.1 |
| 119 | 34.2 | 1.0 |
| 120 | 24.7 | 1.8 |
| 121 | 26.4 | 4.0 |
| 122 | 21.0 | 3.3 |
| 123 | 28.0 | 2.6 |
| 124 | 52.8 | 1.8 |
| 125 | 160.2 | 3.9 |
| 126 | 49.4 | 6.9 |
| 127 | 52.5 | 2.4 |
| 128 | 46.9 | 2.5 |
| 129 | 30.6 | 1.2 |
| 130 | 28.2 | 1.3 |
| 131 | 32.0 | 3.5 |
| 132 | 37.3 | 3.2 |
| 133 | 31.9 | 2.7 |
| 134 | 29.8 | 3.2 |
| 135 | 31.5 | 4.2 |
| 136 | 73.9 | 3.7 |
| 137 | 30.5 | 3.5 |
| 138 | 88.9 | 1.7 |
| 139 | 40.1 | 1.2 |
| 140 | 39.2 | 3.4 |
| 141 | 41.2 | 2.0 |
| 142 | 40.9 | 2.7 |
| 143 | 141.5 | 4.8 |
| 144 | 30.4 | 3.3 |
| 145 | 43.5 | 2.6 |
| 146 | 55.5 | 7.9 |
| 147 | 16.6 | 1.1 |
| 148 | 13.0 | 1.8 |
| 149 | 63.0 | 2.3 |
| 150 | 44.6 | 3.1 |
| 151 | 31.6 | 2.3 |
| 152 | 19.5 | 1.9 |
| 153 | 31.7 | 1.3 |
| 154 | 38.5 | 5.2 |
| 155 | 18.9 | 1.1 |
| 156 | 39.5 | 1.1 |
| 157 | 89.0 | 2.7 |
| 158 | 43.5 | 2.4 |
| 159 | 27.2 | 1.5 |
| 160 | 21.8 | 0.9 |
| 161 | 53.2 | 2.6 |
| 162 | 46.4 | 5.1 |
| 163 | 92.4 | 2.2 |
| 164 | 30.3 | 1.9 |
| 165 | 53.7 | 5.2 |
| 166 | 21.7 | 2.5 |
| 167 | 27.1 | 1.6 |
| 168 | 49.7 | 5.5 |
| 169 | 31.1 | 1.4 |
| 170 | 39.7 | 3.2 |
| 171 | 45.3 | 2.3 |
| 172 | 71.7 | 6.1 |
| 173 | 45.2 | 4.4 |
| 174 | 37.9 | 3.2 |
| 175 | 27.5 | 1.8 |
| 176 | 34.5 | 1.0 |
| 177 | 37.6 | 3.7 |
| 178 | 41.7 | 2.7 |
| 179 | 40.4 | 2.9 |
| 180 | 59.2 | 1.5 |
| 181 | 32.9 | 1.3 |
| 182 | 27.8 | 3.6 |
| 183 | 31.5 | 2.6 |
| 184 | 28.8 | 5.5 |
| 185 | 32.7 | 4.0 |
| 186 | 37.5 | 4.6 |
| 187 | 30.9 | 7.0 |
| 188 | 38.9 | 5.0 |
| 189 | 33.3 | 1.0 |
| 190 | 21.9 | 1.7 |
| 191 | 28.9 | 2.1 |
| 192 | 30.8 | 1.8 |
| 193 | 29.0 | 2.1 |
| 194 | 26.0 | 1.7 |
| 195 | 23.9 | 1.4 |
| 196 | 26.6 | 4.0 |
| 197 | 26.0 | 2.7 |
| 198 | 28.4 | 1.3 |
| 199 | 39.8 | 2.9 |
| 200 | 41.6 | 3.2 |
| 201 | 21.7 | 0.5 |
| 202 | 21.9 | 2.7 |

TABLE 1-continued

Double-Common DsiRNA APOC3 Knockdown in Hep G2 Cells, 0.5 nM 24 hr-5'and -3' Assays % mRNA Remaining (normalized to hSFRS9-F569(HEX) vs Mock Control).

APOC3-F149

| DsiRNA | % mRNA Remaining | % SEM |
|---|---|---|
| 203 | 42.6 | 2.4 |
| 204 | 38.2 | 1.7 |
| 205 | 33.4 | 2.6 |
| 206 | 30.2 | 2.5 |
| 207 | 47.7 | 3.4 |
| 208 | 28.4 | 2.2 |
| 209 | 76.2 | 6.7 |
| 210 | 160.5 | 16.9 |
| 211 | 217.8 | 6.5 |
| 212 | 47.6 | 3.3 |
| 213 | 110.8 | 5.7 |
| 214 | 74.8 | 6.2 |
| 215 | 66.8 | 4.1 |
| 216 | 45.3 | 2.0 |
| 217 | 62.2 | 4.0 |
| 218 | 34.7 | 1.4 |
| 219 | 67.2 | 2.6 |
| 220 | 54.9 | 3.1 |
| 221 | 51.4 | 1.1 |
| 222 | 63.4 | 7.4 |
| 223 | 60.2 | 1.7 |
| 224 | 96.9 | 4.4 |
| 225 | 113.8 | 1.8 |
| 226 | 65.4 | 5.9 |
| 227 | 40.3 | 3.0 |
| 228 | 138.4 | 12.1 |
| 229 | 76.3 | 25.6 |
| 230 | 48.9 | 5.1 |
| 231 | 50.2 | 3.3 |
| 232 | 79.6 | 1.6 |
| 233 | 63.6 | 2.4 |
| 234 | 69.4 | 5.8 |
| 235 | 96.0 | 6.8 |
| 236 | 121.6 | 3.0 |
| 237 | 46.9 | 2.6 |
| 238 | 30.9 | 1.5 |
| 239 | 50.8 | 3.6 |
| 240 | 68.4 | 3.8 |
| 241 | 50.4 | 1.8 |
| 242 | 27.4 | 1.1 |
| 243 | 33.8 | 1.2 |
| 244 | 29.6 | 1.8 |
| 245 | 67.1 | 3.4 |
| 246 | 28.0 | 1.3 |
| 247 | 43.4 | 5.9 |
| 248 | 20.7 | 2.1 |
| 249 | 40.2 | 3.4 |
| 250 | 57.6 | 2.4 |
| 251 | 55.1 | 4.5 |
| 252 | 58.3 | 5.4 |
| 253 | 60.4 | 4.5 |
| 254 | 56.4 | 6.3 |
| 255 | 24.2 | 2.4 |
| 256 | 32.0 | 1.0 |
| 257 | 61.9 | 1.2 |
| 258 | 87.5 | 3.3 |
| 259 | 40.2 | 0.9 |
| 260 | 55.8 | 3.0 |
| 261 | 32.1 | 2.1 |
| 262 | 31.4 | 2.9 |
| 263 | 26.4 | 1.6 |
| 264 | 11.3 | 0.8 |
| 265 | 16.3 | 1.3 |
| 266 | 62.7 | 3.4 |
| 267 | 10.9 | 0.6 |
| 268 | 10.4 | 0.9 |
| 269 | 12.5 | 1.1 |
| 270 | 19.9 | 0.7 |
| 271 | 13.7 | 1.6 |
| 272 | 17.0 | 1.0 |
| 273 | 14.6 | 0.8 |
| 274 | 61.4 | 2.9 |
| 275 | 15.1 | 1.0 |
| 276 | 21.2 | 1.4 |
| 277 | 31.7 | 2.0 |
| 278 | 109.0 | 12.6 |
| 279 | 75.2 | 4.1 |
| 280 | 30.8 | 2.8 |
| 281 | 31.2 | 3.7 |
| 282 | 27.2 | 1.8 |
| 283 | 16.2 | 1.0 |
| 284 | 40.4 | 2.8 |
| 285 | 21.5 | 1.3 |
| 286 | 18.7 | 0.7 |
| 287 | 17.2 | 1.7 |
| 288 | 47.5 | 5.1 |
| 289 | 47.5 | 5.8 |
| 290 | 35.7 | 1.3 |
| 291 | 53.3 | 3.1 |
| 292 | 63.2 | 9.7 |
| 293 | 52.8 | 5.3 |
| 294 | 25.7 | 1.5 |
| 295 | 59.8 | 4.2 |
| 296 | 59.6 | 6.2 |
| 297 | 44.8 | 5.7 |
| 298 | 36.0 | 1.3 |
| 299 | 50.2 | 5.3 |
| 300 | 30.5 | 1.7 |
| 301 | 23.7 | 0.7 |
| 302 | 62.7 | 8.6 |
| 303 | 88.9 | 8.3 |
| 304 | 111.2 | 7.0 |
| 305 | 162.1 | 17.5 |
| 306 | 101.8 | 11.3 |
| 307 | 81.2 | 6.2 |
| 308 | 110.4 | 5.8 |
| 309 | 73.2 | 7.8 |
| 310 | 68.0 | 1.5 |
| 311 | 119.5 | 11.6 |
| 312 | 91.7 | 9.8 |
| 313 | 60.2 | 6.5 |
| 314 | 70.1 | 8.2 |
| 315 | 50.1 | 3.6 |
| 316 | 36.6 | 2.8 |
| 317 | 61.7 | 4.3 |
| 318 | 43.2 | 4.4 |
| 319 | 13.1 | 9.4 |
| 320 | 39.0 | 3.0 |
| 321 | 36.4 | 2.3 |
| 322 | 45.2 | 2.6 |
| 323 | 30.6 | 2.3 |
| 324 | 42.1 | 4.7 |
| 325 | 46.1 | 1.5 |
| 326 | 35.3 | 4.8 |
| 327 | 32.3 | 2.0 |
| 328 | 26.1 | 3.5 |
| 329 | 35.2 | 2.4 |
| 330 | 23.4 | 2.7 |
| 331 | 27.6 | 1.8 |
| 332 | 25.6 | 2.1 |
| 333 | 24.6 | 3.7 |
| 334 | 27.7 | 0.4 |
| 335 | 20.8 | 1.7 |
| 336 | 20.5 | 1.4 |
| 337 | 28.3 | 2.7 |
| 338 | 22.6 | 1.1 |
| 339 | 26.9 | 1.9 |
| 340 | 28.8 | 2.1 |
| 341 | 107.9 | 3.2 |
| 342 | 24.1 | 3.9 |
| 343 | 57.8 | 3.0 |
| 344 | 46.1 | 4.6 |

TABLE 1-continued

Double-Common DsiRNA APOC3 Knockdown in Hep G2 Cells, 0.5 nM 24 hr-5'and -3' Assays % mRNA Remaining (normalized to hSFRS9-F569(HEX) vs Mock Control).

| | APOC3-F149 | |
|---|---|---|
| DsiRNA | % mRNA Remaining | % SEM |
| 345 | 42.7 | 2.8 |
| 346 | 30.2 | 4.0 |
| 347 | 31.1 | 3.7 |
| 348 | 45.6 | 3.1 |
| 349 | 27.6 | 1.8 |
| 350 | 87.1 | 6.6 |
| 351 | 78.0 | 2.2 |
| 352 | 106.0 | 5.4 |
| 353 | 111.1 | 4.7 |
| 354 | 96.5 | 4.6 |
| 355 | 33.1 | 1.9 |
| 356 | 97.4 | 3.2 |
| 357 | 55.8 | 2.1 |
| 358 | 86.5 | 2.2 |
| 359 | 106.4 | 5.6 |
| 360 | 90.5 | 4.4 |
| 361 | 93.7 | 2.9 |
| 362 | 100.5 | 7.5 |
| 363 | 65.7 | 3.5 |
| 364 | 63.0 | 2.6 |
| 365 | 78.2 | 6.0 |
| 366 | 55.2 | 2.7 |
| 367 | 45.8 | 9.4 |
| 368 | 54.6 | 2.0 |
| 369 | 42.6 | 2.2 |
| 370 | 35.4 | 3.4 |
| 371 | 31.8 | 0.5 |
| 372 | 31.3 | 1.8 |
| 373 | 41.1 | 2.3 |
| 374 | 58.5 | 2.1 |
| 375 | 45.5 | 2.8 |
| 376 | 36.3 | 4.5 |
| 377 | 31.8 | 1.5 |
| 378 | 37.7 | 2.1 |
| 379 | 29.2 | 2.1 |
| 380 | 29.6 | 1.7 |
| 381 | 31.2 | 2.0 |
| 382 | 32.7 | 2.0 |
| 383 | 43.9 | 3.7 |
| 384 | 23.7 | 1.6 |

These results show that DsiRNAs designed to target human APOC3 mRNA inhibit APOC3 expression in cells (as determined by a reduced amount of APOC3 mRNA in DsiRNA-transfected cells) and that the nucleotide sequences including the DsiRNA hits are useful for generating RNAi oligonucleotides to inhibit APOC3 expression. Further, these results demonstrate that multiple APOC3 target sequences are suitable for the RNAi-mediated inhibition of APOC3 expression.

Example 3: RNAi Oligonucleotide Inhibition of APOC3 Expression In Vitro-GalXC-Based Compounds Of the 384 DsiRNAs screened in the Hep G2 cell-based assays described in Example 2, the nucleotide sequences of 81 DsiRNAs hits are selected for evaluation in vitro as GalXC-based compounds. Briefly, the nucleotide sequences the selected DsRNAs are used to generate 53 corresponding ds RNAi oligonucleotides including a nicked tetraloop GalNAc-conjugated structure (referred to herein as "GalXC APOC3 oligonucleotides") having a 36-mer sense (passenger) strand and a 22-mer antisense (guide) strand. Further, the nucleotide sequences for the sense strand and antisense strand of the GalXC APOC3 oligonucleotides have a distinct pattern of modified nucleotides and phosphorothioate linkages (see, e.g., FIGS. 1A-IC for a schematic of the generic structure and chemical modification patterns of the GalXC APOC3 oligonucleotides). The three adenosine nucleotides of the tetraloop each are conjugated to a GalNAc moiety (CAS #: 14131-60-3). Further, the nucleotide sequences for the sense strand and antisense strand of the GalXC APOC3 oligonucleotides have one of three distinct patterns of modified nucleotides and phosphorothioate linkages (see, e.g., FIGS. 1A-1C), although exemplary modification patterns are shown in Table 3.

TABLE 2

GalXC-APOC3 Oligonucleotides (unmodified).

| GalXC-APOC3 | Sense Strand (passenger; 36-mer) | SEQ ID NO: | Antisense Strand (guide; 22-mer) | SEQ ID NO: |
|---|---|---|---|---|
| 1 | CUAGAGGCAGCUGCUCCAGAGCAGCCGAAAGGCUGC | 9 | UCUGGAGCAGCUGCCUCUAGGG | 10 |
| 2 | GGUACUCCUUGUUGUUGCCAGCAGCCGAAAGGCUGC | 11 | UGGCAACAACAAGGAGUACCGG | 12 |
| 3 | GAGGCCGAGGAUGCCUCCCAGCAGCCGAAAGGCUGC | 13 | UGGGAGGCAUCCUCGGCCUCGG | 14 |
| 4 | CCUUCUCAGCUUCAUGCAGAGCAGCCGAAAGGCUGC | 15 | UCUGCAUGAAGCUGAGAAGGGG | 16 |
| 5 | CUUCUCAGCUUCAUGCAGGAGCAGCCGAAAGGCUGC | 17 | UCCUGCAUGAAGCUGAGAAGGG | 18 |

TABLE 2-continued

GalXC-APOC3 Oligonucleotides (unmodified).

| GalXC-APOC3 | Sense Strand (passenger; 36-mer) | SEQ ID NO: | Antisense Strand (guide; 22-mer) | SEQ ID NO: |
|---|---|---|---|---|
| 6 | CUCAGCUUCAUGCAGGGUUAGCAGCCGAAAGGCUGC | 19 | UAACCCUGCAUGAAGCUGAGGG | 20 |
| 7 | AUGCACUGAGCAGCGUGCAAGCAGCCGAAAGGCUGC | 21 | UUGCACGCUGCUCAGUGCAUGG | 22 |
| 8 | UGCACUGAGCAGCGUGCAGAGCAGCCGAAAGGCUGC | 23 | UCUGCACGCUGCUCAGUGCAGG | 24 |
| 9 | CUGAGCAGCGUGCAGGAGUAGCAGCCGAAAGGCUGC | 25 | UACUCCUGCACGCUGCUCAGGG | 26 |
| 10 | AGCAGCGUGCAGGAGUCCCAGCAGCCGAAAGGCUGC | 27 | UGGGACUCCUGCACGCUGCUGG | 28 |
| 11 | UGCAGGAGUCCCAGGUGGCAGCAGCCGAAAGGCUGC | 29 | UGCCACCUGGGACUCCUGCAGG | 30 |
| 12 | GGGGCUGGGUGACCGAUGGAGCAGCCGAAAGGCUGC | 31 | UCCAUCGGUCACCCAGCCCCGG | 32 |
| 13 | GGCUUCAGUUCCCUGAAAGAGCAGCCGAAAGGCUGC | 33 | UCUUUCAGGGAACUGAAGCCGG | 34 |
| 14 | CUUCAGUUCCCUGAAAGACAGCAGCCGAAAGGCUGC | 35 | UGUCUUUCAGGGAACUGAAGGG | 36 |
| 15 | UUCAGUUCCCUGAAAGACUAGCAGCCGAAAGGCUGC | 37 | UAGUCUUUCAGGGAACUGAAGG | 38 |
| 16 | AGACUACUGGAGCACCGUUAGCAGCCGAAAGGCUGC | 39 | UAACGGUGCUCCAGUAGUCUGG | 40 |
| 17 | UACUGGAGCACCGUUAAGGAGCAGCCGAAAGGCUGC | 41 | UCCUUAACGGUGCUCCAGUAGG | 42 |
| 18 | UGGAGCACCGUUAAGGACAAGCAGCCGAAAGGCUGC | 43 | UUGUCCUUAACGGUGCUCCAGG | 44 |
| 19 | ACCGUUAAGGACAAGUUCUAGCAGCCGAAAGGCUGC | 45 | UAGAACUUGUCCUUAACGGUGG | 46 |
| 20 | CCGUUAAGGACAAGUUCUCAGCAGCCGAAAGGCUGC | 47 | UGAGAACUUGUCCUUAACGGGG | 48 |
| 21 | CGUUAAGGACAAGUUCUCUAGCAGCCGAAAGGCUGC | 49 | UAGAGAACUUGUCCUUAACGGG | 50 |
| 22 | GUUAAGGACAAGUUCUCUGAGCAGCCGAAAGGCUGC | 51 | UCAGAGAACUUGUCCUUAACGG | 52 |
| 23 | AGGACAAGUUCUCUGAGUUAGCAGCCGAAAGGCUGC | 53 | UAACUCAGAGAACUUGUCCUGG | 54 |
| 24 | AGGACAAGUUCUCUGAGUUAGCAGCCGAAAGGCUGC | 55 | UAACUCAGAGAACUUGUCCUGG | 56 |

TABLE 2-continued

GalXC-APOC3 Oligonucleotides (unmodified).

| GalXC-APOC3 | Sense Strand (passenger; 36-mer) | SEQ ID NO: | Antisense Strand (guide; 22-mer) | SEQ ID NO: |
|---|---|---|---|---|
| 25 | UGCCUGAGACCUCAAUACCAGCAGCCGAAAGGCUGC | 57 | UGGUAUUGAGGUCUCAGGCAGG | 58 |
| 26 | CCCCAAGUCCACCUGCCUAAGCAGCCGAAAGGCUGC | 59 | UUAGGCAGGUGGACUUGGGGGG | 60 |
| 27 | CCCAAGUCCACCUGCCUAUAGCAGCCGAAAGGCUGC | 61 | UAUAGGCAGGUGGACUUGGGGG | 62 |
| 28 | CAAGUCCACCUGCCUAUCCAGCAGCCGAAAGGCUGC | 63 | UGGAUAGGCAGGUGGACUUGGG | 64 |
| 29 | AAGUCCACCUGCCUAUCCAAGCAGCCGAAAGGCUGC | 65 | UUGGAUAGGCAGGUGGACUUGG | 66 |
| 30 | AGUCCACCUGCCUAUCCAUAGCAGCCGAAAGGCUGC | 67 | UAUGGAUAGGCAGGUGGACUGG | 68 |
| 31 | GUCCACCUGCCUAUCCAUCAGCAGCCGAAAGGCUGC | 69 | UGAUGGAUAGGCAGGUGGACGG | 70 |
| 32 | UCCACCUGCCUAUCCAUCCAGCAGCCGAAAGGCUGC | 71 | UGGAUGGAUAGGCAGGUGGAGG | 72 |
| 33 | CCACCUGCCUAUCCAUCCUAGCAGCCGAAAGGCUGC | 73 | UAGGAUGGAUAGGCAGGUGGGG | 74 |
| 34 | CACCUGCCUAUCCAUCCUGAGCAGCCGAAAGGCUGC | 75 | UCAGGAUGGAUAGGCAGGUGGG | 76 |
| 35 | CCUGCCUAUCCAUCUGCGAGCAGCCGAAAGGCUGC | 77 | UCGCAGGAUGGAUAGGCAGGGG | 78 |
| 36 | UCCAUCCUGCGAGCUCCUUAGCAGCCGAAAGGCUGC | 79 | UAAGGAGCUCGCAGGAUGGAGG | 80 |
| 37 | CAUCCUGCGAGCUCCUUGGAGCAGCCGAAAGGCUGC | 81 | UCCAAGGAGCUCGCAGGAUGGG | 82 |
| 38 | AUCCUGCGAGCUCCUUGGGAGCAGCCGAAAGGCUGC | 83 | UCCCAAGGAGCUCGCAGGAUGG | 84 |
| 39 | UCCUGCGAGCUCCUUGGGUAGCAGCCGAAAGGCUGC | 85 | UACCCAAGGAGCUCGCAGGAGG | 86 |
| 40 | GCUGCCCUGUAGGUUGCUAGCAGCCGAAAGGCUGC | 87 | UAGCAACCUACAGGGGCAGCGG | 88 |
| 41 | GUAGGUUGCUUAAAAGGGAAGCAGCCGAAAGGCUGC | 89 | UUCCCUUUUAAGCAACCUACGG | 90 |
| 42 | UAGGUUGCUUAAAAGGGACAGCAGCCGAAAGGCUGC | 91 | UGUCCCUUUUAAGCAACCUAGG | 92 |

TABLE 2-continued

GalXC-APOC3 Oligonucleotides (unmodified).

| GalXC-APOC3 | Sense Strand (passenger; 36-mer) | SEQ ID NO: | Antisense Strand (guide; 22-mer) | SEQ ID NO: |
|---|---|---|---|---|
| 43 | UUGCUUAAAAGGGACAGUAAGCAGCCGAAAGGCUGC | 93 | UUACUGUCCCUUUUAAGCAAGG | 94 |
| 44 | UGCUUAAAAGGGACAGUAUAGCAGCCGAAAGGCUGC | 95 | UAUACUGUCCCUUUUAAGCAGG | 96 |
| 45 | GCUUAAAAGGGACAGUAUUAGCAGCCGAAAGGCUGC | 97 | UAAUACUGUCCCUUUUAAGCGG | 98 |
| 46 | CUUAAAAGGGACAGUAUUCAGCAGCCGAAAGGCUGC | 99 | UGAAUACUGUCCCUUUUAAGGG | 100 |
| 47 | AAAAGGGACAGUAUUCUCAAGCAGCCGAAAGGCUGC | 101 | UUGAGAAUACUGUCCCUUUUGG | 102 |
| 48 | GGACAGUAUUCUCAGUGCUAGCAGCCGAAAGGCUGC | 103 | UAGCACUGAGAAUACUGUCCGG | 104 |
| 49 | GACAGUAUUCUCAGUGCUCAGCAGCCGAAAGGCUGC | 105 | UGAGCACUGAGAAUACUGUCGG | 106 |
| 50 | CAGUAUUCUCAGUGCUCUCAGCAGCCGAAAGGCUGC | 107 | UGAGAGCACUGAGAAUACUGGG | 108 |
| 51 | UAAAGCUGGACAAGAAGCUAGCAGCCGAAAGGCUGC | 109 | UAGCUUCUUGUCCAGCUUUAGG | 110 |
| 52 | AAAGCUGGACAAGAAGCUGAGCAGCCGAAAGGCUGC | 111 | UCAGCUUCUUGUCCAGCUUUGG | 112 |
| 53 | CUGUCCCUAAUAAAGCUGGAGCAGCCGAAAGGCUGC | 113 | UCCAGCUUUAUUAGGGACAGGG | 114 |
| 54 | AGCUUCAUGCAGGGUUACAAGCAGCCGAAAGGCUGC | 115 | UUGUAACCCUGCAUGAAGCUGG | 116 |
| 55 | CUGGAGCACCGUUAAGGACAGCAGCCGAAAGGCUGC | 117 | UGUCCUUAACGGUGCUCCAGGG | 118 |
| 56 | GCACCGUUAAGGACAAGUUAGCAGCCGAAAGGCUGC | 119 | UAACUUGUCCUUAACGGUGCGG | 120 |
| 57 | UGUAGGUUGCUUAAAAGGGAGCAGCCGAAAGGCUGC | 121 | UCCCUUUUAAGCAACCUACAGG | 122 |
| 58 | GUUGCUUAAAAGGGACAGUAGCAGCCGAAAGGCUGC | 123 | UACUGUCCCUUUUAAGCAACGG | 124 |
| 59 | GAGCACCGUUAAGGACAAGAGCAGCCGAAAGGCUGC | 125 | UCUUGUCCUUAACGGUGCUCGG | 126 |
| 60 | AGCACCGUUAAGGACAAGUAGCAGCCGAAAGGCUGC | 127 | UACUUGUCCUUAACGGUGCUGG | 128 |

TABLE 2-continued

GalXC-APOC3 Oligonucleotides (unmodified).

| GalXC-APOC3 | Sense Strand (passenger; 36-mer) | SEQ ID NO: | Antisense Strand (guide; 22-mer) | SEQ ID NO: |
|---|---|---|---|---|
| 61 | CUGUAGGUUGCUUAAAAGGAGCAGCCGAAAGGCUGC | 129 | UCCUUUUAAGCAACCUACAGGG | 130 |
| 62 | AGGUUGCUUAAAAGGGACAAGCAGCCGAAAGGCUGC | 131 | UUGUCCCUUUUAAGCACCUGG | 132 |
| 63 | GGUUGCUUAAAAGGGACAGAGCAGCCGAAAGGCUGC | 133 | UCUGUCCCUUUUAAGCAACCGG | 134 |
| 64 | CCAAUAAAGCUGGACAAGAAGCAGCCGAAAGGCUGC | 135 | UUCUUGUCCAGCUUUAUUGGGG | 136 |
| 65 | AUGGCUUCAGUUCCCUGAAAGCAGCCGAAAGGCUGC | 137 | UUUCAGGGAACUGAAGCCAUGG | 138 |
| 66 | GCUUCAGUUCCCUGAAAGAAGCAGCCGAAAGGCUGC | 139 | UUCUUUCAGGGAACUGAAGCGG | 140 |
| 67 | CAGUUCCCUGAAAGACUACAGCAGCCGAAAGGCUGC | 141 | UGUAGUCUUUCAGGGAACUGGG | 142 |
| 68 | AGUUCCCUGAAAGACUACUAGCAGCCGAAAGGCUGC | 143 | UAGUAGUCUUUCAGGGAACUGG | 144 |
| 69 | CCUGAAAGACUACUGGAGCAGCCGAAAGGCUGC | 145 | UGCUCCAGUAGUCUUUCAGGGG | 146 |
| 70 | GAAAGACUACUGGAGCACCAGCAGCCGAAAGGCUGC | 147 | UGGUGCUCCAGUAGUCUUUCGG | 148 |
| 71 | GACUACUGGAGCACCGUUAAGCAGCCGAAAGGCUGC | 149 | UUAACGGUGCUCCAGUAGUCGG | 150 |
| 72 | ACUGGAGCACCGUUAAGGAAGCAGCCGAAAGGCUGC | 151 | UUCCUUAACGGUGCUCCAGUGG | 152 |
| 73 | GGAGCACCGUUAAGGACAAAGCAGCCGAAAGGCUGC | 153 | UUUGUCCUUAACGGUGCUCCGG | 154 |
| 74 | GCUUCAUGCAGGGUUACAUAGCAGCCGAAAGGCUGC | 155 | UAUGUAACCCUGCAUGAAGCGG | 156 |
| 75 | CACCGUUAAGGACAAGUUCAGCAGCCGAAAGGCUGC | 157 | UGAACUUGUCCUUAACGGUGGG | 158 |
| 76 | ACAAGUUCUCUGAGUUCUGAGCAGCCGAAAGGCUGC | 159 | UCAGAACUCAGAGAACUUGUGG | 160 |
| 77 | AAGUUCUCUGAGUUCUGGGAGCAGCCGAAAGGCUGC | 161 | UCCCAGAACUCAGAGAACUUGG | 162 |
| 78 | AGUUCUCUGAGUUCUGGGAAGCAGCCGAAAGGCUGC | 163 | UUCCCAGAACUCAGAGAACUGG | 164 |

TABLE 2-continued

GalXC-APOC3 Oligonucleotides (unmodified).

| GalXC-APOC3 | Sense Strand (passenger; 36-mer) | SEQ ID NO: | Antisense Strand (guide; 22-mer) | SEQ ID NO: |
|---|---|---|---|---|
| 79 | GUUCUCUGAGUUCUGGGAUAGCAGCCGAAAGGCUGC | 165 | UAUCCCAGAACUCAGAGAACGG | 166 |
| 80 | GGACCCUGAGGUCAGACCAAGCAGCCGAAAGGCUGC | 167 | UUGGUCUGACCUCAGGGUCCGG | 168 |
| 81 | GUAUUCUCAGUGCUCUCCUAGCAGCCGAAAGGCUGC | 169 | UAGGAGAGCACUGAGAAUACGG | 170 |

TABLE 3

GalXC-APOC3 Oligonucleotides (modified).

| GalXC-APOC3 | Sense Strand (passenger; 36-mer) | SEQ ID NO: | Antisense Strand (guide; 22-mer) | SEQ ID NO: |
|---|---|---|---|---|
| 1 | [mCs][mU][mA][mG][mA][mG][mG][fC][fA][mU][mC][mA][mG][mA][mG][mC][mA][mG][mC][mC][mG][ademA-GalNAc][ademA-GalNAc][ademA-GalNAc][mG][mG][mC][mU][mG][mC] | 171 | [MePhosphonate-4O-mUs][fCs][fUs][fG][fG][mA][fG][mC][mA][fG][mC][mU][mG][fC][mC][mU][mC][mU][mA][mGs][mGs][mG] | 172 |
| 2 | [mGs][mG][mU][mA][mC][mU][mC][fC][fU][fU][fG][mU][mU][mG][mU][mU][mG][mC][mC][mA][mG][mC][mA][mG][mC][mC][mG][ademA-GalNAc][ademA-GalNAc][ademA-GalNAc][mG][mG][mC][mU][mG][mC] | 173 | [MePhosphonate-4O-mUs][fGs][fGs][fC][fA][mA][fC][mA][mA][fC][mA][mA][mG][fG][mA][mG][mU][mA][mC][mCs][mGs][mG] | 174 |
| 3 | [mGs][mA][mG][mG][mC][mC][mG][fA][fG][fG][fA][mU][mG][mC][mC][mU][mC][mC][mC][mA][mG][mC][mA][mG][mC][mC][mG][ademA-GalNAc][ademA-GalNAc][ademA-GalNAc][mG][mG][mC][mU][mG][mC] | 175 | [MePhosphonate-4O-mUs][fGs][fGs][fC][fA][mA][fC][mA][mA][fC][mA][mA][mG][fG][mA][mG][mU][mA][mC][mCs][mGs][mG] | 176 |
| 4 | [mCs][mC][mU][mU][mC][mU][mC][fA][fG][fC][fU][mU][mC][mA][mU][mG][mC][mA][mG][mA][mG][mC][mA][mG][mC][mC][mG][ademA-GalNAc][ademA-GalNAc][ademA-GalNAc][mG][mG][mC][mU][mG][mC] | 177 | [MePhosphonate-4O-mUs][fCs][fUs][fG][fC][mA][fU][mG][mA][fA][mG][mC][mU][fG][mA][mG][mA][mA][mG][mGs][mGs][mG] | 178 |
| 5 | [mCs][mU][mU][mC][mU][mC][mA][fG][fC][fU][fU][mC][mA][mU][mG][mC][mA][mG][mC][mA][mG][mC][mA][mG][mC][mC][mG][ademA-GalNAc][ademA-GalNAc][ademA- | 179 | [MePhosphonate-4O-mUs][fCs][fCs][fU][fG][mC][fA][mU][mG][fA][mA][mG][mC][fU][mG][mA][mG][mA][mA][mGs][mGs][mG] | 180 |

TABLE 3-continued

GalXC-APOC3 Oligonucleotides (modified).

| GalXC-APOC3 | Sense Strand (passenger; 36-mer) | SEQ ID NO: | Antisense Strand (guide; 22-mer) | SEQ ID NO: |
|---|---|---|---|---|
| | GalNAc][mG][mG][mC][mU][mG][mC] | | | |
| 6 | [mCs][mU][mC][mA][mG][mC][mU][fU][fC][fA][fU][mG][mC][mA][mG][mG][mG][mU][mU][mA][mG][mC][mA][mG][mC][mC][mG][ademA-GalNAc][ademA-GalNAc][ademA-GalNAc][mG][mG][mC][mU][mG][mC] | 181 | [MePhosphonate-4O-mUs][fAs][fAs][fC][fC][mC][fU][mG][mC][fA][mU][mG][mA][fA][mG][mC][mU][mG][mA][mGs][mGs][mG] | 182 |
| 7 | [mAs][mU][mG][mC][mA][mC][mU][fG][fA][fG][fC][mA][mG][mC][mG][mU][mG][mC][mA][mA][mG][mC][mA][mG][mC][mC][mG][ademA-GalNAc][ademA-GalNAc][ademA-GalNAc][mG][mG][mC][mU][mG][mC] | 183 | [MePhosphonate-4O-mUs][fUs][fGs][fC][fA][mC][fG][mC][mU][fG][mC][mU][mC][fA][mG][mU][mG][mC][mA][mUs][mGs][mG] | 184 |
| 8 | [mUs][mG][mC][mA][mC][mU][mG][fA][fG][fC][fA][mG][mC][mG][mU][mG][mC][mA][mG][mC][mA][mG][mC][mC][mG][ademA-GalNAc][ademA-GalNAc][ademA-GalNAc][mG][mG][mC][mU][mG][mC] | 185 | [MePhosphonate-4O-mUs][fCs][fUs][fG][fC][mA][fC][mG][mC][fU][mG][mC][mU][fC][mA][mG][mU][mG][mC][mAs][mGs][mG] | 186 |
| 9 | [mCs][mU][mG][mA][mG][mC][mA][fG][fC][fG][fU][mG][mC][mA][mG][mG][mA][mG][mU][mA][mG][mC][mA][mG][mC][mC][mG][ademA-GalNAc][ademA-GalNAc][ademA-GalNAc][mG][mG][mC][mU][mG][mC] | 187 | [MePhosphonate-4O-mUs][fAs][fCs][fU][fC][mC][fU][mG][mC][fA][mC][mG][mC][fU][mG][mC][mU][mC][mA][mGs][mGs][mG] | 188 |
| 10 | [mAs][mG][mC][mA][mG][mC][mG][fU][fG][fC][fA][mG][mG][mA][mG][mU][mC][mC][mC][mA][mG][mC][mA][mG][mC][mC][mG][ademA-GalNAc][ademA-GalNAc][ademA-GalNAc][mG][mG][mC][mU][mG][mC] | 189 | [MePhosphonate-4O-mUs][fGs][fGs][fG][fA][mC][fU][mC][mC][fU][mG][mC][mA][fC][mG][mC][mU][mG][mC][mUs][mGs][mG] | 190 |
| 11 | [mUs][mG][mC][mA][mG][mG][mA][fG][fU][fC][fC][mC][mA][mG][mG][mU][mG][mG][mC][mA][mG][mC][mA][mG][mC][mC][mG][ademA-GalNAc][ademA-GalNAc][ademA-GalNAc][mG][mG][mC][mU][mG][mC] | 191 | [MePhosphonate-4O-mUs][fGs][fCs][fC][fA][mC][fC][mU][mG][fG][mG][mA][mC][fU][mC][mC][mU][mG][mC][mAs][mGs][mG] | 192 |
| 12 | [mGs][mG][mG][mG][mC][mU][mG][fG][fG][mG][mA][mU][mG][mG][mA][mG][mC][mA][mG][mC][mC][mG][ademA-GalNAc][ademA- | 193 | [MePhosphonate-4O-mUs][fCs][fCs][fA][fU][mC][fG][mG][mU][fC][mA][mC][mC][fC][mA][mG][mC][mC][mC][mCs][mGs][mG] | 194 |

TABLE 3-continued

GalXC-APOC3 Oligonucleotides (modified).

| GalXC-APOC3 | Sense Strand (passenger; 36-mer) | SEQ ID NO: | Antisense Strand (guide; 22-mer) | SEQ ID NO: |
|---|---|---|---|---|
| | GalNAc][ademA-GalNAc][mG][mG][mC][[mU][mG][mC] | | | |
| 13 | [mGs][mG][mC][mU][mU][mC][mA][fG][fU][mG][mA][mA][mA][mG][mA][mG][mC][mA][mG][mC][mC][mG][ademA-GalNAc][ademA-GalNAc][ademA-GalNAc][mG][mG][mC][mU][mG][mC] | 195 | [MePhosphonate-4O-mUs][fCs][fUs][fU][fU][mC][fA][mG][fG][mA][mA][mC][fU][mG][mA][mA][mG][mC][mCs][mGs][mG] | 196 |
| 14 | [mCs][mU][mU][mC][mA][mG][mU][fU][fC][fC][fC][mU][mG][mA][mA][mA][mG][mA][mC][mA][mG][mC][mA][mG][mC][mC][mG][ademA-GalNAc][ademA-GalNAc][ademA-GalNAc][mG][mG][mC][m][mG][mC] | 197 | [MePhosphonate-4O-mUs][fGs][fUs][fC][fU][mU][fU][mC][mA][fG][mG][mG][mA][fA][mC][mU][mG][mA][mA][mGs][mGs][mG] | 198 |
| 15 | [mUs][mU][mC][mA][mG][mU][mU][fC][fC][mA][mG][mA][mA][mC][mU][mA][mG][mC][mA][mG][mC][mC][mG][ademA-GalNAc][ademA-GalNAc][ademA-GalNAc][mG][mG][mC][mU][mG][mC] | 199 | [MePhosphonate-4O-mUs][fAs][fGs][fU][fC][mU][fU][mU][mC][fA][mG][mG][mG][fA][mA][mC][mU][mG][mA][mAs][mGs][mG] | 200 |
| 16 | [mAs][mG][mA][mC][mU][mA][mC][fU][fG][fG][fA][mG][mC][mA][mC][mC][mG][mU][mU][mA][mG][mC][mA][mG][mC][mC][mG][ademA-GalNAc][ademA-GalNAc][ademA-GalNAc][mG][mG][mC][mU][mG][mC] | 201 | [MePhosphonate-4O-mUs][fAs][fAs][fC][fG][mG][fU][mG][mC][fU][mC][mC][mA][fG][mU][mA][mG][mU][mC][mUs][mGs][mG] | 202 |
| 17 | [mUs][mA][mC][mU][mG][mG][mA][fG][fC][fA][fC][mC][mG][mU][mU][mA][mA][mG][mG][mA][mG][mC][mA][mG][mC][mC][mG][ademA-GalNAc][ademA-GalNAc][ademA-GalNAc][mG][mG][mC][mU][mG][mC] | 203 | [MePhosphonate-4O-mUs][fCs][fCs][fU][fU][mA][fA][mC][mG][fG][mU][mG][mC][fU][mC][mC][mA][mG][mU][mAs][mGs][mG] | 204 |
| 18 | [mUs][mG][mG][mA][mG][mC][mA][fC][fC][fG][fU][mU][mA][mA][mG][mG][mA][mC][mA][mA][mG][mC][mA][mG][mC][mC][mG][ademA-GalNAc][ademA-GalNAc][ademA-GalNAc][mG][mG][mC][mU][mG][mC] | 205 | [MePhosphonate-4O-mUs][fUs][fGs][fU][fC][mC][fU][mU][mA][fA][mC][mG][mG][fU][mG][mC][mU][mC][mC][mAs][mGs][mG] | 206 |
| 19 | [mAs][mC][mC][mG][mU][mU][mA][fA][fG][fG][fA][mC][mA][mA][mG][mU][mU][mC][mU][mA][mG][mC][mA]mG][mC][mC][mG][ademA-GalNAc][ademA-GalNAc] | 207 | [MePhosphonate-4O-mUs][fAs][fGs][fA][fA][mC][fU][mU][mG][fU][mC][mC][mU][fU][mA][mA][mC][mG][mG][mUs][mGs][mG] | 208 |

TABLE 3-continued

GalXC-APOC3 Oligonucleotides (modified).

| GalXC-APOC3 | Sense Strand (passenger; 36-mer) | SEQ ID NO: | Antisense Strand (guide; 22-mer) | SEQ ID NO: |
|---|---|---|---|---|
| | [ademA-GalNAc][mG][mG][mC][mU][mG][mC] | | | |
| 20 | [mCs][mC][mU][mU][mA][mA][fG][fG][fA][fC][mA][mA][mG][mU][mU][mC][mU][mC][mA][mG][mC][mA][mG][mC][mC][mG][ademA-GalNAc][ademA-GalNAc][ademA-GalNAc][mG][mG][mC][mU][mG][mC] | 209 | [MePhosphonate-40-mUs][fGs][fAs][fG][fA][mA][fC][mU][mU][fG][mU][mC][mC][fU][mU][mA][mA][mC][mG][mGs][mGs][mG] | 210 |
| 21 | [mCs][mG][mU][mU][mA][mA][mG][fG][fA][fC][fA][mA][mG][mU][mU][mC][mU][mC][mU][mA][mG][mC][mA][mG][mC][mC][mG][ademA-GalNAc][ademA-GalNAc][ademA-GalNAc][mG][mG][mC][mU][mG][mC] | 211 | [MePhosphonate-40-mUs][fAs][fGs][fA][fG][mA][fA][mC][mU][mU][fG][mU][mC][mC][mU][mU][mA][mA][mC][mGs][mGs][mG] | 212 |
| 22 | [mGs][mU][mU][mA][mA][mG][mG][fA][fC][fA][fA][mG][mU][mu][mC][mU][mC][mU][mG][mA][mG][mG][mC][mA][mG][mC][mC][mG][ademA-GalNAc][ademA-GalNAc][ademA-GalNAc][mG][mG][mC][mU][mG][mC] | 213 | [MePhosphonate-40-mUs][fCs][fAs][fG][fA][mG][fA][mA][mC][fU][mU][mA][mA][mCs][mGs][mG] | 214 |
| 23 | [mAs][mG][mG][mA][mC][mA][mA][fG][fU][fU][fC][mU][mC][mU][mG][mA][mG][mU][mU][mA][mG][mC][mA][mG][mC][mC][mG][ademA-GalNAc][ademA-GalNAc][ademA-GalNAc][mG][mG][mC][mU][mG][mC] | 215 | [MePhosphonate-40-mUs][fAs][fAs][fC][fU][mC][fA][mG][mA][fG][mA][mA][mC][fU][mU][mG][mU][mC][mC][mUs][mGs][mG] | 216 |
| 24 | [mAs][mG][fG][mA][mC][mA][mA][fG][fU][fG][mA][fG][mU][mU][mA][mG][mC][mA][mG][mC][mC][mC][prgG-peg-GalNAc][prgA-peg-GalNAc][prgA-peg-GalNAc][mG][mG][mC][mU][mG][mC] | 217 | [Phosphonate-40-mUs][fAs][fAs][mC][fU][mC][fA][mG][mA][fG][mA][fA][mC][fU][mU][fG][mU][mC][fC][mUs][mGs][mG] | 218 |
| 25 | [mUs][mG][mC][mC][mU][mG][mA][fG][fA][fC][fC][mU][mC][mA][mA][mU][mA][mC][mC][mA][mG][mC][mA][mG][mC][mC][mG][ademA-GalNAc][ademA-GalNAc][ademA-GalNAc][mG][mG][mC][mU][mG][mC] | 219 | [MePhosphonate-40-mUs][fGs][fGs][fU][fA][mU][fU][mG][mA][fG][mG][mU][mC][fU][mC][mA][mG][mG][mC][mAs][mGs][mG] | 220 |
| 26 | [mCs][mC][mC][mC][mA][mA][mG][fU][fC][fC][fA][mC][mC][mU][mG][mG][mC][mU][mA][mA][mG][mC][mA][mG][mC][mC][mG][ademA-GalNAc][ademA- | 221 | [MePhosphonate-40-mUs][fUs][fAs][fG][fG][mC][fA][mG][mG][fU][mG][mG][mA][fC][mU][mU][mG][mG][mG][mGs][mGs][mG] | 222 |

TABLE 3-continued

GalXC-APOC3 Oligonucleotides (modified).

| GalXC-APOC3 | Sense Strand (passenger; 36-mer) | SEQ ID NO: | Antisense Strand (guide; 22-mer) | SEQ ID NO: |
|---|---|---|---|---|
| | GalNAc][ademA-GalNAc][mG][mG][mC][mU][mG][mC] | | | |
| 27 | [mCs][mC][mC][mA][mA][mG][mU][fC][fC][fA][fC][mC][mU][mG][mC][mC][mU][mA][mU][mA][mG][mC][mA][mG][mC][mC][mG][ademA-GalNAc][ademA-GalNAc][ademA-GalNAc][mG][mG][mC][mU][mG][mC] | 223 | [MePhosphonate-4O-mUs][fAs][fUs][fA][fG][mG][fC][mA][mG][fG][mU][mG][mG][fA][mC][mU][mU][mG][mG][mGs][mGs][mG] | 224 |
| 28 | [mCs][mA][mA][mG][mU][mC][mC][fA][fC][fC][fU][mG][mC][mC][mU][mA][mU][mC][mC][mA][mG][mC][mA][mG][mC][mC][mG][ademA-GalNAc][ademA-GalNAc][ademA-GalNAc][mG][mG][mC][mU][mG][mC] | 225 | [MePhosphonate-4O-mUs][fGs][fGs][fA][fU][mA][fG][mG][mC][fA][mG][mG][mU][fG][mG][mA][mC][mU][mU][mGs][mGs][mG] | 226 |
| 29 | [mAs][mA][mG][mU][mC][mC][mA][fC][fC][fU][fG][mC][mC][mU][mA][mU][mC][mC][mA][mA][mG][mC][mA][mG][mC][mC][mG][ademA-GalNAc][ademA-GalNAc][ademA-GalNAc][mG][mG][mC][mU][mG][mC] | 227 | [MePhosphonate-4O-mUs][fUs][fGs][fG][fA][mU][fA][mG][mG][fC][mA][mG][mG][fU][mG][mG][mA][mC][mU][mUs][mGs][mG] | 228 |
| 30 | [mAs][mG][mU][mC][mC][mA][mC][fC][fU][fG][fC][mC][mU][mA][mU][mC][mC][mA][mU][mA][mG][mC][mA][mG][mC][mC][mG][ademA-GalNAc][ademA-GalNAc][ademA-GalNAc][mG][mG][mC][mU][mG][mC] | 229 | [MePhosphonate-4O-mUs][fAs][fUs][fG][fG][mA][fU][mA][mG][fG][mC][mA][mG][fG][mU][mG][mG][mA][mC][mUs][mGs][mG] | 230 |
| 31 | [mGs][mU][mC][mC][fC][fC][mU][mA][mU][mC][mC][mA][mU][mC][mA][mG][mC][mA][mG][mC][mC][mG][ademA-GalNAc][ademA-GalNAc][ademA-GalNAc][mG][mG][mC][mU][mG][mC] | 231 | [MePhosphonate-4O-mUs][fGs][fAs][fU][fG][mG][fA][mU][mA][fG][mG][mC][mA][fG][mG][mU][mG][mG][mA][mCs][mGs][mG] | 232 |
| 32 | [mUs][mC][mC][mA][mC][mC][mU][fG][fC][mC][mA][mU][mC][mC][mA][mG][mC][mA][mG][mC][mC][mG][ademA-GalNAc][ademA-GalNAc][ademA-GalNAc][mG][mG][mC][mU][mG][mC] | 233 | [MePhosphonate-4O-mUs][fGs][fGs][fA][fU][mG][fG][mA][mU][fA][mG][mG][mC][fA][mG][mG][mU][mG][mG][mAs][mGs][mG] | 234 |
| 33 | [mCs][mC][mA][mC][mC][mU][mG][fC][fC][fU][fA][mU][mC][mC][mA][mU][mC][mC][mU][mA][mG][mC][mA][mG][mC][mC][mG][ademA-GalNAc][ademA-GalNAc][ademA- | 235 | [MePhosphonate-4O-mUs][fAs][fGs][fG][fA][mU][fG][mG][mA][fU][mA][mG][mG][fC][mA][mG][mG][mU][mG][mGs][mGs][mG] | 236 |

TABLE 3-continued

GalXC-APOC3 Oligonucleotides (modified).

| GalXC-APOC3 | Sense Strand (passenger; 36-mer) | SEQ ID NO: | Antisense Strand (guide; 22-mer) | SEQ ID NO: |
|---|---|---|---|---|
|  | GalNAc][mG][mG][mC][mU][mG][mC] |  |  |  |
| 34 | [mCs][mA][mC][mC][mU][mG][mC][fC][fU][fA][fU][mC][mC][mA][mU][mC][mC][mU][mG][mA][mG][mC][mA][mG][mC][mC][mG][ademA-GalNAc][ademA-GalNAc][ademA-GalNAc][mG][mG][mC][mU][mG][mC] | 237 | [MePhosphonate-40-mUs][fCs][fAs][fG][fG][mA][fU][mG][mG][fA][mU][mA][mG][fG][mC][mA][mG][mG][mU][mGs][mGs][mG] | 238 |
| 35 | [mCs][mC][mU][mG][mC][mC][mU][fA][fU][fC][fC][mA][mU][mC][mC][mU][mG][mC][mG][mA][mG][mC][mA][mG][mC][mC][mG][ademA-GalNAc][ademA-GalNAc][ademA-GalNAc][mG][mG][mC][mU][mG][mC] | 239 | [MePhosphonate-40-mUs][fCs][fGs][fC][fA][mG][fG][mA][mU][fG][mG][mA][mU][fA][mG][mG][mC][mA][mG][mGs][mGs][mG] | 240 |
| 36 | [mUs][mC][mC][mA][mU][mC][mC][fU][fG][fC][fG][mA][mG][mC][mU][mC][mC][mU][mU][mA][mG][mC][mA]mG][mC][mC][mG][ademA-GalNAc][ademA-GalNAc][ademA-GalNAc][mG][mG][mC][mU][mG][mC] | 241 | [MePhosphonate-40-mUs][fAs][fAs][fG][fG][mA][fG][mC][m][fC][mG][mC][mA][fG][mG][mA][mU][mG][mG][mAs][mGs][mG] | 242 |
| 37 | [mCs][mA][mU][mC][mC][mU][mG][fC][fG][fA][fG][mC][mU][mC][mC][mU][mU][mG][mG][mA][mC][mA][mG][mC][mC][mG][ademA-GalNAc][ademA-GalNAc][ademA-GalNAc][mG][mG][mC][mU][mG][mC] | 243 | [MePhosphonate-40-mUs][fCs][fCs][fA][fA][mG][fG][mA][mG][fC][mU][mC][mG][fC][mA][mG][mG][mA][mU][mGs][mGs][mG] | 244 |
| 38 | [mAs][mU][mC][mC][mU][mG][mC][fG][fA][fG][fC][mU][mC][mC][mU][mU][mG][mG][mG][mA][mG][mC][mA][mG][mC][mC][mG][ademA-GalNAc][ademA-GalNAc][ademA-GalNAc][mG][mG][mC][mU][mG][mC] | 245 | [MePhosphonate-40-mUs][fCs][fCs][fC][fA][mA][fG][mG][mA][fG][mC][mU][mC][fG][mC][mA][mG][mG][mA][mUs][mGs][mG] | 246 |
| 39 | [mUs][mC][mC][mU][mG][mC][mG][fA][fG][fC][fU][mC][mC][mU][mU][mG][mG][mG][mU][mA][mG][mC][mA][mG][mC][mC][mG][ademA-GalNAc][ademA-GalNAc][ademA-GalNAc][mG][mG][mC][mU][mG][mC] | 247 | [MePhosphonate-40-mUs][fAs][fCs][fC][fC][mA][fA][mG][mG][fA][mG][mC][mU][fC][mG][mC][mA][mG][mG][mAs][mGs][mG] | 248 |
| 40 | [mGs][mC][mU][mG][fG][fU][mA][mG][mG][mU][mU][mG][mC][mU][mA][mG][mC][mA][mG][mC][mC][mG][ademA-GalNAc][ademA- | 249 | [MePhosphonate-40-mUs][fAs][fGs][fC][fA][mA][fC][mC][mU][fA][mC][mA][mG][fG][mG][mG][mC][mA][mG][mCs][mGs][mG] | 250 |

TABLE 3-continued

GalXC-APOC3 Oligonucleotides (modified).

| GalXC-APOC3 | Sense Strand (passenger; 36-mer) | SEQ ID NO: | Antisense Strand (guide; 22-mer) | SEQ ID NO: |
|---|---|---|---|---|
| | GalNAc][ademA-GalNAc][mG][mG][mC][mU][mG][mC] | | | |
| 41 | [mGs][mU][mA][mG][mG][mU][mU][fG][fC][fU][fU][mA][mA][mA][mA][mA][mG][mG][mG][mA][mA][mG][mC][mA][mG][mC][mC][mG][ademA-GalNAc][ademA-GalNAc][ademA-GalNAc][mG][mG][mC][mU][mG][mC] | 251 | [MePhosphonate-4O-mUs][fUs][fCs][fC][fC][mU][fU][mU][mU][fA][mA][mG][mC][fA][mA][mC][mC][mU][mA][mCs][mGs][mG] | 252 |
| 42 | [mUs][mA][mG][mG][mU][mU][mG][fC][fU][fU][fA][mA][mA][mA][mG][mG][mG][mA][mC][mA][mG][mC][mA][mG][mC][mC][mG][ademA-GalNAc][ademA-GalNAc][ademA-GalNAc][mG][mG][mC][mU][mG][mC] | 253 | [MePhosphonate-4O-mUs][fGs][fUs][fC][fC][mC][fU][mU][mU][fU][mA][mA][mG][fC][mA][mA][mC][mC][mU][mAs][mGs][mG] | 254 |
| 43 | [mUs][mU][mG][mC][mU][mU][mA][fA][fA][fA][fG][mG][mG][mA][mC][mA][mG][mU][mA][mA][mG][mC][mA][mG][mC][mC][mG][ademA-GalNAc][ademA-GalNAc][ademA-GalNAc][mG][mG][mC][mU][mG][mC] | 255 | [MePhosphonate-4O-mUs][fUs][fAs][fC][fU][mG][fU][mC][mC][fC][mU][mU][mU][fU][mA][mA][mG][mC][mA][mAs][mGs][mG] | 256 |
| 44 | [mUs][mG][mC][mU][mU][mA][mA][fA][fA][fG][fG][mG][mA][mC][mA][mU][mG][mA][mG][mU][mA][mG][mC][mA][mG][mC][mC][mG][ademA-GalNAc][ademA-GalNAc][ademA-GalNAc][mG][mG][mC][mU][mG][mC] | 257 | [MePhosphonate-4O-mUs][fAs][fUs][fA][fC][mU][fG][mU][mC][fC][mC][mU][mU][fU][mU][mA][mA][mG][mC][mAs][mGs][mG] | 258 |
| 45 | [mGs][mC][mU][mU][mA][mA][mA][fA][fG][fG][fG][mA][mC][mA][mG][mU][mA][mU][mU][mA][mG][mC][mA][mG][mC][mC][mG][ademA-GalNAc][ademA-GalNAc][ademA-GalNAc][mG][mG][mC][mU][mG][mC] | 259 | [MePhosphonate-4O-mUs][fAs][fAs][fU][fA][mC][fU][mG][mU][fC][mC][mC][mU][fU][mU][mU][mA][mA][mG][mCs][mGs][mG] | 260 |
| 46 | [mCs][mU][mU][mA][mA][mA][mA][fG][fG][fG][fA][mC][mA][mG][mU][mA][mU][mU][mC][mA][mG][mC][mA][mG][mC][mC][mG][ademA-GalNAc][ademA-GalNAc][ademA-GalNAc][mG][mG][mC][mU][mG][mC] | 261 | [MePhosphonate-4O-mUs][fGs][fAs][fA][fU][mA][fC][mU][mG][fU][mC][mC][mC][fU][mU][mU][mU][mA][mA][mGs][mGs][mG] | 262 |
| 47 | [mAs][mA][mA][mA][mG][mG][mG][fA][fC][fA][fG][mU][mA][mU][mU][mC][mU][mC][mA][mA][mG][mC][mA][mG][mC][mC][mG] | 263 | [MePhosphonate-4O-mUs][fUs][fGs][fA][fG][mA][fA][mU][mA][fC][mU][mG][mU][fC][mC][mC][mU][mU][mU][mUs][mGs][mG] | 264 |

TABLE 3-continued

GalXC-APOC3 Oligonucleotides (modified).

| GalXC-APOC3 | Sense Strand (passenger; 36-mer) | SEQ ID NO: | Antisense Strand (guide; 22-mer) | SEQ ID NO: |
|---|---|---|---|---|
| | [ademA-GalNAc][ademA-GalNAc][ademA-GalNAc][mG][mG][mC][mU][mG][mC] | | | |
| 48 | [mGs][mG][mA][mC][mA][mG][mU][fA][fU][fU][fC][fU][mC][mA][mG][mU][mG][mC][mU][mA][mG][mC][mA][mG][mC][mC][mG][ademA-GalNAc][ademA-GalNAc][ademA-GalNAc][mG][mG][mC][mU][mG][mC] | 265 | [MePhosphonate-4O-mUs][fAs][fGs][fC][fA][mC][fU][mG][mA][fG][mA][mA][mU][fA][mC][mU][mG][mU][mC][mCs][mGs][mG] | 266 |
| 49 | [mGs][mA][mC][mA][mG][mU][mA][fU][fU][fC][fU][mC][mA][mG][mU][mG][mC][mU][mC][mA][mG][mC][mA][mG][mC][mC][mG][ademA-GalNAc][ademA-GalNAc][ademA-GalNAc][mG][mG][mC][mU][mG][mC] | 267 | [MePhosphonate-4O-mUs][fGs][fAs][fG][fC][mA][fC][mU][mG][fA][mG][mA][mA][fU][mA][mC][mU][mG][mU][mCs][mGs][mG] | 268 |
| 50 | [mCs][mA][mG][mU][mA][mU][mU][fC][fU][fC][fA][mG][mU][mG][mC][mU][mC][mU][mC][mA][mG][mC][mA][mG][mC][mC][mG][ademA-GalNAc][ademA-GalNAc][ademA-GalNAc][mG][mG][mC][mU][mG][mC] | 269 | [MePhosphonate-4O-mUs][fGs][fAs][fG][fA][mG][fC][mA][mC][mU][mG][mA][mG][fA][mA][mU][mA][mC][mU][mGs][mGs][mG] | 270 |
| 51 | [mUs][mA][mA][mA][mG][mC][mU][fG][fG][fA][fC][mA][mA][mG][mA][mA][mG][mC][mU][mA][mG][mC][mA][mG][mC][mC][mG][ademA-GalNAc][ademA-GalNAc][ademA-GalNAc][mG][mG][mC][mU][mG][mC] | 271 | [MePhosphonate-4O-mUs][fAs][fGs][fC][fU][mU][fC][mU][mU][fG][mU][mC][mC][fA][mG][mC][mU][mU][mU][mAs][mGs][mG] | 272 |
| 52 | [mAs][mA][mA][mG][mC][mU][mG][fG][fA][fC][fA][mA][mG][mA][mA][mG][mC][mU][mG][mA][mG][mC][mA][mG][mC][mC][mG][ademA-GalNAc][ademA-GalNAc][ademA-GalNAc][mG][mG][mC][mU][mG][mC] | 273 | [MePhosphonate-4O-mUs][fCs][fAs][fG][fC][mU]fU][mC][mU][fU][mG][mU][mC][fC][mA][mG][mC][mU][mU][mUs][mGs][mG] | 274 |
| 53 | [mCs][mU][fG][mU][fC][mC][mC][fU][fA][fA][fU][mA][fA][mA][fG][mC][fU][mG][mG][mA][mG][mC][mA][mG][mC][mC][mG][ademA-GalNAc][ademA-GalNAc][ademA-GalNAc][mG][mG][mC][mU][mG][mC] | 275 | [MePhosphonate-4O-mUs][fCs][fCs][mA][fG][mC][f][mU][mU][fA][mU][fU][mA][fG][mG][fG][fA][mC][fA][mGs][mGs][mG] | 276 |
| 54 | [mAs][mG][fC][mU][mU][mC][mA][fU][fG][fC][mA][fG][fG][mG][mU][mU][fA][mC][mA][mA][mG][mC][mA][mG][mC][mC][prgG-peg-GalNAc][prgA-peg- | 277 | [Phosphonate-4O-mUs][fUs][fGs][mU][fA][mA][fC][fC][mC][fU][mG][fC][mA][fU][mG][fA][mA][mG][fC][mUs][mGs][mG] | 278 |

TABLE 3-continued

GalXC-APOC3 Oligonucleotides (modified).

| GalXC-APOC3 | Sense Strand (passenger; 36-mer) | SEQ ID NO: | Antisense Strand (guide; 22-mer) | SEQ ID NO: |
|---|---|---|---|---|
| | GalNAc][prgA-peg-GalNAc][prgA-peg-GalNAc][mG][mG][mC][mU][mG][mC] | | | |
| 55 | [mCs][mU][fG][mG][mA][mG][mC][fA][fC][fC][mG][fU][fU][mA][mA][mG][fG][mA][mC][mA][mG][mC][mA][mG][mC][mC][prgG-peg-GalNAc][prgA-peg-GalNAc][prgA-peg-GalNAc][mG][mG][mC][mU][mG][mC] | 279 | [Phosphonate-40-mUs][fGs][fUs][mC][fC][mU][fU][fA][mA][fC][mG][fG][mU][fG][mC][fU][mC][mC][fA][mGs][mGs][mG] | 280 |
| 56 | [mGs][mC][fA][mC][mC][mG][mu][fU][fA][fA][mG][fG][fA][mC][mA][mA][fG][mU][mU][mA][mG][mC][mA][mG][mC][mC][prgG-peg-GalNAc][prgA-peg-GalNAc][prgA-peg-GalNAc][mG][mG][mC][mU][mG][mC] | 281 | [Phosphonate-40-mUs][fAs][fAs][mC][fU][mU][fG][fU][mC][fC][mU][fU][mA][fA][mC][fG][mG][mU][fG][mCs][mGs][mG] | 282 |
| 57 | [mUs][mG][fU][mA][mG][mG][mU][fU][fG][fC][mU][fU][fA][mA][mA][mA][fG][mG][mG][mA][mG][mC][mA][mG][mC][mC][prgG-peg-GalNAc][prgA-peg-GalNAc][prgA-peg-GalNAc][mG][mG][mC][mU][mG][mC] | 283 | [Phosphonate-40-mUs][fCs][fCs][mC][fU][mU][fU][fU][mA][fA][mG][fC][mA][fA][mC][fC][mU][mA][fC][mAs][mGs][mG] | 284 |
| 58 | [mGs][mU][fU][mG][mC][mU][mU][fA][fA][fA][mA][fG][fG][mG][mA][mC][fA][mG][mU][mA][mG][mC][mC][prgG-peg-GalNAc][prgA-peg-GalNAc][prgA-peg-GalNAc][mG][mG][mC][mU][mG][mC] | 285 | [Phosphonate-40-mUs][fAs][fCs][mU][fG][mU][fC][fC][mC][fU][mU][fU][mU][fA][mA][fG][mC][mA][fA][mCs][mGs][mG] | 286 |
| 5 | [mGs][mA][fG][mC][fA][mC][mC][fG][fU][fU][fA][mA][fG][mG][fA][mC][fA][mA][mG][mA][mG][mC][mA][mG][mC][mC][prgG-peg-GalNAc][prgA-peg-GalNAc][prgA-peg-GalNAc][mG][mG][mC][mU][mG][mC] | 287 | [Phosphonate-40-mUs][fCs][fUs][mU][fG][mU][fC][mC][mU][fU][mA][fA][mC][fG][mG][fU][fG][mC][fU][mCs][mGs][mG] | 288 |
| 60 | [mAs][mG][fC][mA][fC][mC][mG][fU][fU][fA][fA][mG][fG][mA][fC][mA][fA][mG][mU][mA][mG][mC][mA][mG][mC][mC][prgG-peg-GalNAc][prgA-peg-GalNAc][prgA-peg-GalNAc][prgA-peg-GalNAc] | 289 | [Phosphonate-40-mUs][fAs][fCs][mU][fU][mG][fU][mC][fC][mU][fU][mU][fA][mA][fC][fG][mG][fU][mG][fC][mUs][mGs][mG] | 290 |

TABLE 3-continued

GalXC-APOC3 Oligonucleotides (modified).

| GalXC-APOC3 | Sense Strand (passenger; 36-mer) | SEQ ID NO: | Antisense Strand (guide; 22-mer) | SEQ ID NO: |
|---|---|---|---|---|
| | GalNAc][mG][mC][mU][mG][mC] | | | |
| 61 | [mCs][mU][fG][mU][fA][mG][mG][fU][fU][fG][fC][mU][fU][mA][fA][mA][fA][mG][mG][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 291 | [Phosphonate-40-mUs][fCs][fCs][mU][fU][mA][mA][fC][mC][fU][fA][mC][fA][mGs][mGs][mG] | 292 |
| 62 | [mAs][mG][fG][mU][fU][mG][mC][fU][fU][fA][fA][mA][fA][mG][fG][mG][fA][mC][mA][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 293 | [Phosphonate-40-mUs][fUs][fGs][mU][fC][mC][fC][mU][mU][fU][mU][fA][mA][fG][mC][fA][fA][mC][fC][mUs][mGs][mG] | 294 |
| 63 | [mGs] [mG][fU][mU][fG][mC][mU][fU][fA][fA][mA][fG][mG][mG][mA][fC][mA][mG][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 295 | [Phosphonate-40-mUs][fCs][fUs][mG][fU][mC][fC][mC][mU][fU][mU][fU][mA][fA][mG][fC][fA][mA][fC][mCs][mGs][mG] | 296 |
| 64 | [mCs][mC][fA][mA][fU][mA][mA][fA][fG][fC][fU][mG][fG][mA][fC][mA][fA][mG][mA][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 297 | [Phosphonate-40-mUs][fUs][fCs][mU][fU][mG][fU][mC][mC][fA][mG][fC][mU][fU][mU][fA][fU][mU][fG][mGs][mGs][mG] | 298 |
| 65 | [mAs][mU][fG][mG][fC][mU][mU][fC][fA][fG][fU][mU][fC][mC][fC][mU][fG][mA][mA][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 299 | [Phosphonate-40-mUs][fUs][fUs][mC][fA][mG][fG][mG][mA][fA][mC][fU][mG][fA][mA][fG][fC][mC][[A][mUs][mGs][mG] | 300 |
| 66 | [mGs][mC][fU][mU][fC][mA][mG][fU][fU][fC][fC][mC][fU][mG][fA][mA][fA][mG][mA][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 301 | [Phosphonate-40-mUs][fUs][fCs][mU][fU][mU][fC][mA][mG][fG][mG][fA][mA][fC][mU][fG][fA][mA][fG][mCs][mGs][mG] | 302 |

TABLE 3-continued

GalXC-APOC3 Oligonucleotides (modified).

| GalXC-APOC3 | Sense Strand (passenger; 36-mer) | SEQ ID NO: | Antisense Strand (guide; 22-mer) | SEQ ID NO: |
|---|---|---|---|---|
| 67 | [mCs][mA][fG][mU][fU][mC][mC][fC][fU][fG][fA][mA][A][G][fA][mC][fU][mA][mC][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 303 | [Phosphonate-40-mUs][fGs][fUs][mA][fG][mU][fC][mU][mU][fC][fA][mG][fG][mG][fA][fA][mC][fU][mGs][mGs][mG] | 304 |
| 68 | [mAs][mG][fU][mU][fC][mC][mC][fU][fG][fA][fA][mA][fG][mA][fC][mU][fA][mC][mU][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 305 | [Phosphonate-40-mUs][fAs][fGs][mU][fA][mG][fU][mC][mU][fU][mU][fC][mA][fG][mG][fG][fA][mA][fC][mUs][mGs][mG] | 306 |
| 69 | [mCs][mC][fU][mG][fA][mA][mA][fG][fA][fC][fU][mA][fC][mU][fG][mG][fA][mG][mC][mA][mG][mC][mA][mG][mC][mC][prgG-peg-GalNAc][prgA-peg-GalNAc][prgA-peg-GalNAc][prgA-peg-GalNAc][mG][mG][mC]][mU][mG][mC] | 307 | [Phosphonate-40-mUs][fGs][fCs][mU][fC][mC][[A][mG][mU][fA][mG][fU][mC][fU][mU][fU][fC][mA][fG][mGs][mGs][mG] | 308 |
| 70 | [mGs][mA][fA][mA][fG][mA][mC][fU][fA][fC][fU][mG][fG][mA][fG][mC][fA][mC][mC][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 309 | [Phosphonate-40-mUs][fGs][fGs][mU][fG][mC][fU][mC][mC][fA][mG][fU][mA][fG][mU][fC][fU][mU][fU][mCs][mGs][mG] | 310 |
| 71 | [mGs][mA][fC][mU][fA][mC][mU][fG][fG][fA][fG][mC][fA][mC][fC][mG][fU][mU][mA][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 311 | [Phosphonate-40-mUs][fUs][fAs][mA][fC][mG][fG][mU][mG][fC][mU][fC][mC][fA][mG][fU][fA][mG][fU][mCs][mGs][mG] | 312 |
| 72 | [mAs][mC][fU][mG][fG][mA][mG][fC][fA][fC][fC][mG][fU][mU][fA][mA][fG][mG][mA][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 313 | [Phosphonate-40-mUs][fUs][fCs][mC][fU][mU][fA][mA][mC][fG][mG][fA][fG][mUs][mGs][mG] | 314 |
| 73 | [mGs][mG][fA][mG][fC][mA][mC][fC][fG][fU][fU][mA][fA][mG][fG] | 315 | [Phosphonate-40-mUs][fUs][fUs][mG][fU][mC][fC][mU][mU][fA][mA] | 316 |

TABLE 3-continued

GalXC-APOC3 Oligonucleotides (modified).

| GalXC-APOC3 | Sense Strand (passenger; 36-mer) | SEQ ID NO: | Antisense Strand (guide; 22-mer) | SEQ ID NO: |
|---|---|---|---|---|
| | [mA][fC][mA][mA][mA][mG][mC][mA][mG][mC][mC][prgG-peg-GalNAc][prgA-peg-GalNAc][prgA-peg-GalNAc][mG][mG][mC][mU][mG][mC] | | [fC][mG][fG][mU][fG][fC][mU][fC][mCs][mGs][mG] | |
| 74 | [mGs][mC][fU][mU][fC][mA][mU][fG][fC][fA][fG][mG][fG][mU][fU][mA][fC][mA][mU][mA][mG][mC][mA][mG][mC][mC][prgG-peg-GalNAc][prgA-peg-GalNAc][prgA-peg-GalNAc][mG][mG][mC][mU][mG][mC] | 317 | [Phosphonate-40-mUs][fAs][fUs][mG][fU][mA][fA][mC][mC][fC][mU][fG][mC][fA][mU][fG][fA][mA][fG][mCs][mGs][mG] | 318 |
| 75 | [mCs][mA][fC][mC][fG][mU][mU][fA][fA][fG][fG][mA][fC][mA][fA][mG][fU][mU][mC][mA][mG][mC][mA][mG][mC][mC][prgG-peg-GalNAc][prgA-peg-GalNAc][prgA-peg-GalNAc][mG][mG][mC][mU][mG][mC] | 319 | [Phosphonate-40-mUs][fGs][fAs][mA][fC][mU][fU][mG][mU][fC][mC][fU][mU][fA][mA][fC][fG][mG][fU][mGs][mGs][mG] | 320 |
| 76 | [mAs][mC][fA][mA][fG][mU][mU][fC][fU][fC][fU][mG][fA][mG][fU][mU][fC][mU][mG][mA][mG][mC][mA][mG][mC][mC][prgG-peg-GalNAc][prgA-peg-GalNAc][prgA-peg-GalNAc][mG][mG][mC][mU][mG][mC] | 321 | [Phosphonate-40-mUs][fCs][fAs][mG][fA][mA][fC][mU][mC][fA][mG][fA][mG][fA][mA][fC][fU][mU][fG][mUs][mGs][mG] | 322 |
| 77 | [mAs][mA][fG][mU][mU][mC][mU][fC][fU][fG][mA][fG][fU][mU][mC][mU][fG][mG][mG][mA][mG][mC][mA][mG][mC][prgG-peg-GalNAc][prgA-peg-GalNAc][prgA-peg-GalNAc][mG][mG][mC][mU][mG][mC] | 323 | [Phosphonate-40-mUs][fCs][fCs][mC][fA][mG][fA][fA][mC][fU][mC][fA][mG][fA][mG][fA][mA][mC][fU][mUs][mGs][mG] | 324 |
| 78 | [mAs][mG][fU][mU][mC][mU][mC][fU][fG][fA][mG][fU][fU][mC][mU][mG][fG][mG][mA][mA][mG][mC][mA][mG][mC][mC][prgG-peg-GalNAc][prgA-peg-GalNAc][prgA-peg-GalNAc][mG][mG][mC][mU][mG][mC] | 325 | [Phosphonate-40-mUs│[fUs][fCs][mC][fC][mA][fG][fA][mA][fC][mU][fC][mA][fG][mA][fG][mA][mA][fC][mUs][mGs][mG] | 326 |
| 79 | [mGs][mU][fU][mC][mU][mC][mU][fG][fA][fG][mU][fU][fC][mU][mG][mG][fG][mA][mU][mA][mG][mC][mA][mG][mC][mC][prgG-peg- | 327 | [Phosphonate-40-mUs][fAs][fUs][mC][fC][mC][fA][fG][mA][fA][mC][fU][mC][fA][mG][fA][mG][mA][fA][mCs][mGs][mG] | 328 |

TABLE 3-continued

GalXC-APOC3 Oligonucleotides (modified).

| GalXC-APOC3 | Sense Strand (passenger; 36-mer) | SEQ ID NO: | Antisense Strand (guide; 22-mer) | SEQ ID NO: |
|---|---|---|---|---|
| | GalNAc][prgA-peg-<br>GalNAc][prgA-peg-<br>GalNAc][prgA-peg-<br>GalNAc][mG][mG][mC]<br>[mU][mG][mC] | | | |
| 80 | [mGs][mG][fA][mC]<br>[mC][mC][mU][fG][fA]<br>[fG][mG][fU][fC][mA]<br>[mG][mA][fC][mC][mA]<br>[mA][mG][mC][mA][mG]<br>[mC][mC][prgG-peg-<br>GalNAc][prgA-peg-<br>GalNAc][prgA-peg-<br>GalNAc][prgA-peg-<br>GalNAc][mG][mG][mC]<br>[mU][mG][mC] | 329 | [Phosphonate-4O-<br>mUs][fUs][fGs][mG][fU]<br>[mC][fU][fG][mA][fC][mC]<br>[fU][mC][fA][mG][fG][mG]<br>[mU][fC][mCs][mGs][mG] | 330 |
| 81 | [mGs][mU][fA][mU]<br>[mU][mC][mU][fC][fA]<br>[fG][mU][fG][fC][mU]<br>[mC][mU][fC][mC][mU]<br>[mA][mG][mC][mA][mG]<br>[mC][mC][prgG-peg-<br>GalNAc][prgA-peg-<br>GalNAc][prgA-peg-<br>GalNAc][prgA-peg-<br>GalNAc][mG][mG][mC]<br>[mU][mG][mC] | 331 | [Phosphonate-4O-<br>mUs][fAs][fGs][mG][fA]<br>[mG][fA][fG][mC][fA][mC]<br>[fU][mG][fA][mG][fA][mA]<br>[mU][fA][mCs][mGs][mG] | 332 |

In Vivo Function

Example 4: RNAi Oligonucleotide Inhibition of APOC3 Expression In Vitro

Mouse studies: Various GalXC APOC3 oligonucleotides, which are listed in Tables 2 (unmodified) and 3 (modified), are evaluated in hydrodynamic injection (HDI) mouse model. Additional HDI studies are listed in Tables 5-13. For these HDI studies, the mice are engineered to transiently express human APOC3 mRNA in hepatocytes. A GalXC APOC3 oligonucleotide control is used as a benchmark control. Briefly, 6-8-week-old female CD-1 mice are treated SQ with a GalXC APOC3 oligonucleotide at a dose level of 1 mg/kg. Three days later (72 hr), the mice are hydrodynamically injected with a DNA plasmid encoding the full human APOC3 gene under control of a ubiquitous cytomegalovirus (CMV) promoter sequence. One day after introduction of the plasmid, liver samples are collected. Total RNA derived from these mice are individuated to qRT-PCR analysis for APOC3 mRNA, relative to mice treated only with an identical volume of PBS. The values are normalized for transfection efficiency using the NeoR gene included on the plasmid.

As shown in Tables 4-12, a number of GalXC APOC3 oligonucleotides tested inhibited APOC3 expression, as determined by a reduced amount of APOC3 mRNA in liver samples from oligonucleotide-treated mice relative to mice treated with PBS. The mean % of remaining APOC3 mRNA in liver samples of mice treated with the benchmark GalXC APOC3 oligonucleotide control relative to mice treated with PBS. Table 4 shows that several the 12 GalXC APOC3 oligonucleotides tested inhibit APOC3 expression to a greater extent than the reference GalXC APOC3 oligonucleotide used as control. Sequences of these oligonucleotides along with the modification patterns and SEQ ID NOs. are disclosed in Tables 2 and 3 in connection with FIG. 1.

TABLE 4

30-Day In Vivo Activity of Double-Common GalXC-APOC3 Oligonucleotides in Mice (GalXC single-dose, 3 mg/kg, 96-hr harvest; HDI of hAPOC3 Plasmid in Mice).

| GalXC-APOC3 | Animal | | | | | | |
|---|---|---|---|---|---|---|---|
| | 1 | 2 | 3 | 4 | 5 | Average | SEM |
| PBS | 58.2 | 49.5 | 117.8 | 174.5 | — | 100.0 | 29.1 |
| 6 | 40.8 | 21.4 | 26.1 | 21.5 | 35.8 | 30.9 | 4.9 |
| 15 | 17.7 | 31.1 | 21.5 | 14.4 | 4.3 | 17.8 | 4.4 |
| 20 | 15.8 | 20.1 | 22.0 | 7.3 | 10.5 | 15.2 | 2.8 |
| 22 | 27.0 | 17.9 | 27.0 | 39.7 | 20.2 | 26.4 | 3.8 |
| 41 | 35.4 | 42.5 | 30.8 | 11.9 | 7.1 | 25.5 | 6.9 |
| 42 | 17.1 | 39.7 | 52.2 | 24.1 | 15.2 | 29.7 | 7.1 |
| 43 | 58.1 | 53.9 | 129.4 | 117.7 | 60.7 | 84.0 | 16.3 |
| 54 | 71.4 | 77.4 | 35.1 | 60.8 | 35.8 | 56.1 | 8.9 |
| 55 | 116.9 | 73.4 | 90.0 | 68.4 | 80.7 | 85.9 | 8.6 |
| 56 | 34.3 | 32.4 | 16.3 | 74.9 | — | 39.5 | 12.5 |
| 57 | 77.3 | 111.4 | 45.2 | 52.4 | 71.5 | 71.5 | 11.6 |
| 58 | — | 49.8 | 7.6 | 24.4 | 75.8 | 49.4 | 10.5 |

Tables 5-12 show additional sets of HDI mouse studies with GalXC-APOC3 oligonucleotides using the same reference oligonucleotide.

TABLE 5

30-Day In Vivo Activity of Double-Common GalXC-APOC3 Oligonucleotides in Mice (GalXC single-dose, 3 mg/kg, 96-hr harvest; HDI of hAPOC3 Plasmid in Mice).

| GalXC-APOC3 | 1 | 2 | 3 | 4 | 5 | Average | SEM |
|---|---|---|---|---|---|---|---|
| PBS | 126.6 | 158.2 | 50.1 | 107.6 | 57.5 | 100.0 | 20.6 |
| 13 | 45.7 | 29.7 | 23.7 | 18.6 | 34.9 | 30.5 | 4.7 |
| 14 | 35.2 | 14.9 | 25.7 | 30.5 | 21.7 | 25.6 | 3.5 |
| 15 | 4.4 | 6.3 | 11.3 | — | — | 7.3 | 2.0 |
| 17 | 22.2 | 29.4 | 21.7 | 18.4 | 15.6 | 21.4 | 2.3 |
| 18 | 17.1 | 35.8 | 25.4 | 24.6 | 32.69 | 27.1 | 3.3 |
| 44 | 12.2 | 23.1 | 7.4 | 12.0 | 10.9 | 13.1 | 2.6 |
| 59 | 52.5 | 53.1 | 56.0 | 38.2 | 38.8 | 47.7 | 3.8 |
| 60 | 36.4 | 58.9 | 45.1 | 31.2 | 39.4 | 42.2 | 4.7 |
| 61 | 25.7 | 36.1 | 98.2 | 51.9 | 102.7 | 62.9 | 15.9 |
| 62 | 73.7 | 56.3 | 76.5 | 41.8 | 121.6 | 74.0 | 13.5 |
| 63 | 136.5 | 75.2 | 42.1 | 116.6 | 31.9 | 80.4 | 20.4 |
| 64 | 54.6 | 48.6 | 37.6 | 48.5 | 62.8 | 50.4 | 4.1 |

TABLE 6

30-Day In Vivo Activity of Double-Common GalXC-APOC3 Oligonucleotides in Mice (GalXC single-dose, 3 mg/kg, 96-hr harvest; HDI of hAPOC3 Plasmid in Mice).

| GalXC-APOC3 | 1 | 2 | 3 | 4 | 5 | Average | SEM |
|---|---|---|---|---|---|---|---|
| PBS | 90.2 | 130.2 | 60.7 | 75.3 | 143.6 | 100.0 | 15.9 |
| 15 | 18.3 | 36.6 | 22.0 | 21.3 | 21.9 | 24.0 | 3.2 |
| 44 | 18.9 | 29.2 | 15.6 | 18.2 | 18.6 | 20.1 | 2.3 |
| 45 | 29.4 | 26.1 | 41.3 | 25.4 | 27.0 | 29.8 | 2.9 |
| 46 | 25.4 | 18.6 | 30.5 | 26.0 | 13.5 | 22.8 | 3.0 |
| 65 | 54.5 | 57.3 | 80.7 | 75.5 | 57.6 | 65.1 | 5.4 |
| 66 | 42.8 | 72.7 | 30.8 | 35.8 | 54.3 | 47.3 | 7.5 |
| 67 | 44.3 | 54.4 | 32.4 | 44.8 | 38.4 | 42.9 | 3.7 |
| 68 | 36.6 | 33.8 | 46.6 | 35.7 | 48.0 | 40.1 | 3.0 |
| 69 | 40.3 | 48.2 | 26.9 | 31.5 | 46.5 | 38.7 | 4.1 |
| 70 | 128.1 | 24.3 | 29.8 | 70.5 | 55.7 | 61.7 | 18.6 |
| 71 | 72.1 | 74.7 | 65.0 | 83.2 | 54.0 | 69.8 | 4.9 |
| 72 | 66.0 | 39.9 | 51.7 | 38.3 | 38.8 | 47.0 | 5.4 |
| 73 | 53.8 | 41.2 | 37.9 | 42.6 | 74.8 | 50.0 | 6.7 |

TABLE 7

30-Day In Vivo Activity of Double-Common GalXC-APOC3 Oligonucleotides in Mice (GalXC single-dose, 3 mg/kg, 96-hr harvest; HDI of hAPOC3 Plasmid in Mice; Assay 1 top table, and Assay 2 bottom table).

Assay 1

| GalXC-APOC3 | 1 | 2 | 3 | 4 | 5 | Average | SEM |
|---|---|---|---|---|---|---|---|
| PBS | 103.4 | 91.8 | 76.1 | 133.6 | 95.1 | 100.0 | 9.5 |
| 15 | 47.5 | 38.6 | 24.6 | 23.9 | 34.9 | 33.9 | 4.6 |
| 19 | 64.1 | 24.0 | 25.5 | 22.4 | 33.3 | 33.8 | 7.8 |
| 21 | 20.9 | 39.1 | 22.5 | 18.5 | — | 25.2 | 4.7 |
| 23 | 16.8 | 13.2 | 30.7 | 20.1 | 15.0 | 19.2 | 3.1 |
| 51 | 53.9 | 25.2 | 25.4 | 24.4 | 54.4 | 36.7 | 7.1 |
| 74 | 59.5 | 73.2 | 101.2 | 63.2 | 67.0 | 72.8 | 7.5 |
| 75 | 79.9 | 75.9 | 83.6 | 106.3 | 124.1 | 93.9 | 9.2 |
| 76 | 69.1 | 38.9 | 60.6 | 49.9 | 59.5 | 55.6 | 5.2 |
| 77 | 55.0 | 44.8 | 72.8 | 89.9 | 93.5 | 71.2 | 9.5 |
| 78 | 76.8 | 65.3 | 84.5 | 79.9 | 98.3 | 81.0 | 5.4 |
| 79 | 68.7 | 62.0 | 83.9 | 63.9 | 98.2 | 75.3 | 6.9 |
| 80 | 75.2 | 97.6 | 102.2 | 68.6 | 91.4 | 87.0 | 6.5 |
| 81 | 55.6 | 36.3 | 55.4 | 44.4 | 58.8 | 50.1 | 4.2 |

Assay 2

| GalXC-APOC3 | 1 | 2 | 3 | 4 | 5 | Average | SEM |
|---|---|---|---|---|---|---|---|
| PBS | 111.7 | 78.9 | 77.3 | 131.9 | 100.3 | 100.0 | 10.3 |
| 15 | 57.1 | 42.3 | 34.1 | 27.4 | 47.6 | 41.7 | 5.2 |
| 19 | 91.7 | 60.2 | 64.8 | 71.6 | 67.2 | 71.1 | 5.5 |
| 21 | 24.6 | 51.4 | 25.7 | 21.7 | — | 30.9 | 6.9 |
| 23 | 23.5 | 20.6 | 34.4 | 31.7 | 24.5 | 26.9 | 2.6 |
| 51 | 57.9 | 33.8 | 32.9 | 30.7 | 43.5 | 39.8 | 5.0 |
| 74 | 66.1 | 72.3 | 87.2 | 60.1 | 59.7 | 69.1 | 5.1 |
| 75 | 91.4 | 82.9 | 133.6 | 109.6 | 124.4 | 108.4 | 9.6 |
| 76 | 74.0 | 51.0 | 75.9 | 53.4 | 59.6 | 62.8 | 5.2 |
| 77 | 45.4 | 52.1 | 81.5 | 77.5 | 116.7 | 74.6 | 12.6 |
| 78 | 69.4 | 60.1 | 82.7 | 93.8 | 89.3 | 79.1 | 6.3 |
| 79 | 79.1 | 71.4 | 79.8 | 77.5 | 106.3 | 82.8 | 6.1 |
| 80 | 115.2 | 164.4 | 121.3 | 109.9 | 191.2 | 140.4 | 15.9 |
| 81 | 63.2 | 42.9 | 57.6 | 48.2 | 62.4 | 54.8 | 4.0 |

TABLE 8

30-Day In Vivo Activity of Double-Common GalXC-APOC3 Oligonucleotides in Mice (GalXC single-dose, 1 mg/kg, 96-hr harvest; HDI of hAPOC3 Plasmid in Mice).

| GalXC-APOC3 | 1 | 2 | 3 | 4 | 5 | Average | SEM |
|---|---|---|---|---|---|---|---|
| PBS | 112.0 | 119.2 | 92.8 | 76.9 | — | 100.0 | 9.7 |
| 6 | 15.4 | 71.6 | 23.4 | 34.9 | 41.1 | 37.3 | 9.6 |
| 13 | 82.7 | 150.1 | 88.9 | 86.4 | 122.1 | 106.0 | 13.1 |
| 14 | 28.8 | 33.6 | 33.1 | 37.3 | 57.0 | 38.0 | 4.9 |
| 15 | 21.4 | 15.2 | 23.6 | 19.7 | 18.4 | 19.6 | 1.4 |
| 17 | 39.4 | 53.7 | 32.5 | 58.6 | 49.5 | 46.8 | 4.8 |
| 18 | 22.5 | 34.6 | 27.4 | 15.9 | 21.8 | 24.4 | 3.1 |
| 19 | 13.9 | 24.6 | 33.8 | 13.8 | 16.5 | 20.5 | 3.9 |
| 20 | 83.8 | 28.0 | 34.5 | 66.8 | 43.1 | 51.2 | 10.5 |
| 21 | 42.8 | 18.7 | 105.3 | 26.1 | 25.7 | 43.7 | 15.9 |
| 22 | 39.5 | 44.9 | 69.1 | 36.1 | — | 47.4 | 7.5 |
| 23 | 43.6 | 39.9 | 75.1 | 33.5 | 20.1 | 42.4 | 9.1 |
| 41 | 48.4 | 30.9 | 16.1 | 35.3 | 19.3 | 30.0 | 5.8 |
| 42 | 76.3 | 59.1 | 79.1 | 50.1 | 78.4 | 68.6 | 5.9 |
| 44 | 122.3 | 46.4 | 39.7 | 40.5 | 34.8 | 56.7 | 16.5 |
| 45 | 35.7 | 30.5 | 45.9 | 90.2 | — | 50.65 | 13.6 |
| 46 | 12.4 | 8.3 | 25.0 | 5.8 | 58.0 | 21.9 | 9.6 |
| 51 | 43.6 | 82.4 | 81.3 | 113.3 | 74.9 | 79.1 | 11.1 |

TABLE 9

30-Day In Vivo Activity of Double-Common GalXC-APOC3 Oligonucleotides in Mice (GalXC single-dose, 1 mg/kg, 96-hr harvest; HDI of hAPOC3 Plasmid in Mice).

| GalXC-APOC3 | 1 | 2 | 3 | 4 | 5 | Average | SEM |
|---|---|---|---|---|---|---|---|
| PBS | 98.5 | 72.7 | 130.1 | 93.0 | 105.8 | 100.0 | 9.3 |
| 1 | 123.9 | 61.4 | 118.7 | 114.8 | 81.3 | 100.0 | 12.2 |
| 6 | 58.5 | 78.2 | 76.4 | 41.6 | 26.0 | 56.1 | 10.0 |
| 14 | 74.8 | 161.2 | 100.1 | 75.8 | 139.9 | 110.4 | 17.4 |
| 15 | 82.7 | 67.4 | 67.5 | 62.5 | 51.6 | 66.3 | 5.0 |
| 16 | 118.0 | 77.4 | 85.2 | 178.4 | 117.2 | 115.3 | 17.8 |
| 18 | 90.7 | 51.3 | 87.6 | 93.6 | 97.8 | 84.2 | 8.4 |
| 19 | 52.9 | 34.0 | 72.8 | 68.2 | 75.5 | 60.7 | 7.7 |
| 21 | 119.6 | 93.3 | 110.5 | 57.4 | 80.2 | 92.2 | 11.0 |
| 25 | 141.0 | 68.7 | 69.6 | 66.6 | 85.0 | 86.2 | 14.1 |
| 40 | 65.9 | 55.4 | 53.11 | 128.7 | 80.5 | 76.7 | 13.9 |
| 41 | 57.4 | 173.7 | 41.8 | 61.5 | 44.8 | 75.9 | 24.7 |
| 43 | 87.9 | 39.4 | 81.4 | 54.0 | 81.5 | 68.8 | 9.4 |
| 46 | 45.5 | 43.8 | 32.2 | 35.4 | 65.8 | 44.6 | 5.9 |
| 47 | 35.5 | 58.5 | 24.4 | 34.5 | 19.4 | 34.5 | 6.7 |
| 52 | 132.4 | 61.3 | 124.5 | 57.0 | 122.5 | 99.6 | 16.6 |

TABLE 10

30-Day In Vivo Activity of Double-Common GalXC-APOC3 Oligonucleotides in Mice (GalXC single-dose, 1 mg/kg, 96-hr harvest; HDI of hAPOC3 Plasmid in Mice).

| GalXC-APOC3 | Animal 1 | 2 | 3 | 4 | 5 | Average | SEM |
|---|---|---|---|---|---|---|---|
| PBS | 89.5 | 82.7 | 158.9 | 72.2 | 96.6 | 100.0 | 15.3 |
| 2 | 126.1 | 88.2 | — | 95.6 | 77.0 | 96.7 | 10.5 |
| 3 | 84.6 | 87.3 | 56.7 | 93.8 | 68.0 | 77.4 | 6.6 |
| 4 | 107.0 | — | 108.8 | 81.3 | 79.4 | 94.1 | 8.0 |
| 5 | 71.5 | 102.7 | 95.2 | 97.7 | 531 | 84.0 | 9.4 |
| 7 | 75.5 | 69.9 | 128.7 | 82.1 | 127.5 | 96.7 | 13.0 |
| 8 | 87.4 | 106.1 | 125.3 | 119.2 | 110.4 | 109.7 | 6.5 |
| 9 | 63.8 | 65.2 | 58.4 | 54.2 | 55.1 | 59.3 | 2.2 |
| 10 | 81.5 | 151.4 | 65.0 | 60.3 | 94.3 | 90.5 | 16.4. |
| 11 | 88.7 | 106.3 | 80.4 | 88.4 | 91.1 | 91.0 | 4.2 |
| 12 | 96.4 | 78.0 | 99.4 | 69.8 | 82.6 | 85.32 | 5.6 |
| 15 | 33.4 | 25.8 | 45.8 | 52.9 | 50.5 | 41.7 | 5.2 |
| 26 | 52.0 | 87.1 | 62.9 | 53.1 | 47.8 | 60.6 | 7.1 |
| 27 | 84.8 | 76.5 | 80.2 | 45.4 | 78.8 | 73.1 | 7.1 |
| 28 | 82.3 | 111.2 | 74.2 | 80.7 | 64.8 | 82.6 | 7.8 |
| 29 | 64.4 | 62.5 | 94.5 | 63.4 | 70.2 | 71.0 | 6.0 |

TABLE 11

30-Day In Vivo Activity of Double-Common GalXC-APOC3 Oligonucleotides in Mice (GalXC single-dose, 1 mg/kg, 96-hr harvest; HDI of hAPOC3 Plasmid in Mice).

| GalXC-APOC3 | Animal 1 | 2 | 3 | 4 | 5 | Average | SEM |
|---|---|---|---|---|---|---|---|
| PBS | 89.5 | 82.7 | 158.9 | 72.2 | 96.6 | 100.0 | 15.3 |
| 15 | 64.4 | 62.5 | 94.5 | 63.4 | 70.2 | 71.0 | 6.0 |
| 15 | 33.4 | 25.8 | 45.8 | 52.9 | 50.5 | 41.7 | 5.2 |
| 30 | 126.1 | 88.2 | — | 95.6 | 77.0 | 96.7 | 10.5 |
| 31 | 84.6 | 83.7 | 56.7 | 93.8 | 68.0 | 77.4 | 6.6 |
| 32 | 107.0 | — | 108.8 | 81.3 | 79.4 | 94.1 | 8.0 |
| 33 | 71.5 | 102.7 | 95.2 | 97.7 | 53.1 | 84.0 | 9.4 |
| 34 | 75.5 | 69.9 | 128.7 | 82.1 | 127.5 | 96.7 | 13.0 |
| 35 | 87.4 | 106.1 | 125.3 | 119.2 | 110.4 | 109.7 | 6.5 |
| 36 | 63.8 | 65.2 | 58.4 | 54.2 | 55.1 | 59.3 | 2.2 |
| 37 | 81.5 | 151.4 | 65.0 | 60.3 | 94.3 | 90.5 | 16.4 |
| 38 | 88.7 | 106.3 | 80.4 | 88.4 | 91.1 | 91.0 | 4.2 |
| 39 | 96.4 | 78.0 | 99.4 | 69.8 | 82.6 | 85.3 | 5.6 |
| 48 | 52.0 | 87.1 | 62.9 | 53.1 | 47.8 | 60.6 | 7.1 |
| 49 | 84.8 | 76.5 | 80.2 | 45.4 | 78.8 | 73.1 | 7.1 |
| 50 | 82.3 | 111.2 | 74.2 | 80.7 | 64.8 | 82.6 | 7.8 |
| 50 | 87.5 | 86.6 | 66.8 | 74.0 | 50.0 | 73.0 | 6.9 |

TABLE 12

30-Day In Vivo Activity of Double-Common GalXC-APOC3 Oligonucleotides in Mice (GalXC single-dose, 1 mg/kg, 96-hr harvest; HDI of hAPOC3 Plasmid in Mice).

| GalXC-APOC3 | Animal 1 | 2 | 3 | 4 | 5 | Average | SEM |
|---|---|---|---|---|---|---|---|
| PBS | 136.0 | 97.0 | 136.9 | 86.2 | 73.6 | 105.9 | 13.0 |
| PBS1 | 75.0 | 132.9 | 111.63 | 76.5 | — | 99.0 | 14.1 |
| PBS2 | 62.8 | 67.4 | 113.4 | 172.8 | 57.9 | 94.9 | 21.9 |
| 6 | 84.2 | 96.1 | 52.3 | 63.8 | 82.2 | 73.7 | 6.7 |
| 9 | 60.0 | 92.3 | 3.6 | 78.4 | 108.7 | 84.6 | 8.0 |
| 15 | 35.7 | 62.0 | 80.1 | 71.4 | 48.6 | 59.6 | 7.9 |
| 19 | 59.5 | 39.9 | 376 | 66.5 | 43.2 | 49.3 | 5.8 |
| 26 | 81.3 | 71.7 | 93.0 | 48.5 | 53.0 | 69.5 | 8.4 |
| 40 | 86.0 | 62.7 | 36.9 | 85.9 | 74.3 | 69.2 | 9.1 |
| 41 | 41.1 | 37.1 | 34.0 | 34.5 | 48.8 | 39.1 | 2.7 |
| 43 | 62.3 | 87.7 | 89.8 | 82.5 | 83.3 | 81.1 | 4.9 |
| 46 | 46.7 | 49.7 | 35.0 | 32.2 | 34.9 | 39.7 | 3.5 |
| 47 | 34.3 | 52.6 | 71.7 | 24.9 | 38.9 | 44.5 | 8.1 |
| 49 | 60.5 | 43.2 | 32.1 | 87.5 | 48.9 | 54.4 | 9.5 |
| 50 | 62.8 | 67.4 | 113.4 | 172.8 | 57.9 | 94.9 | 21.9 |

Based on these results, 8 GalXC-APOC3 oligonucleotides are selected for evaluation of their ability to inhibit APOC3 expression in NHPs, 6 of which are selected for being double common and 2 of which are unique to human only. The GalXC-APOC3 oligonucleotides have chemically modified nucleotides of the pattern as shown in FIG. 1, especially FIG. 1C.

NHP studies: Eight GalXC-APOC3 oligonucleotides selected from the mouse studies above are evaluated in cynomolgus monkeys (*Macaca fascicularis*) for a single-dose (6 mg/kg), 84-day study. Here, the NHPs are grouped so that their mean body weights (about 5.4 kg) are comparable between the control and experimental groups. Each cohort contains 5 individuals (2 male and 3 female individuals). The GalXC-APOC3 oligonucleotides are administered SQ on Study Day 0. Blood samples are collected at 2 pre-dose time points (i.e., Days −21 and 0) and then weekly after dosing for a liver enzyme panel and lipid profile. Ultrasound-guided core needle liver biopsies are collected on Study Days −21, 28, 56, and 83. At each time point, total RNA derived from the liver biopsy samples is individuated to qRT-PCR analysis to measure APOC3 mRNA in oligonucleotide-treated monkeys relative to monkeys treated with a comparable volume of PBS. To normalize the data, the measurements are made relative to the geometric mean of two reference genes, PPIB and 18S rRNA. As shown in Table 13, treating NHPs with the GalXC-APOC3 oligonucleotides inhibits APOC3 expression in the liver, as determined by a reduced amount of APOC3 mRNA in liver samples from oligonucleotide-treated NHPs relative to NHPs treated with PBS. For all time points evaluated, GalXC-APOC3 oligonucleotides inhibit APOC3 expression to a greater extent than the benchmark PBS and time-matched controls. From the same NHP study, inhibition of APOC3 expression is also determined by measuring APOC3 protein in serum prepared from the pre-dose and weekly blood samples by ELISA. Taken together, these results demonstrate that treating NHPs with GalXC-APOC3 oligonucleotides reduces the amount of APOC3 mRNA in the liver and concomitantly reduces the amount of APOC3 protein in the serum.

TABLE 13

APOC3 mRNA Knockdown of Select GalXC-APOC3
Oligonucleotides in NHP at Day 83 vs. Pre-Dose.

| | | | Animal | | | | | | | |
|---|---|---|---|---|---|---|---|---|---|---|
| | | Week | 1 | 2 | 3 | 4 | 5 | 6 | Avg | SEM |
| GalXC-APOC3 | PBS | 3 | 88.8 | 170.9 | 92.7 | 57.8 | 73.8 | 115.9 | 100 | 16.3 |
| | | 4 | 75.1 | 93.0 | 104.5 | 43.1 | 67.2 | 126 | 84.8 | 12 |
| | | 8 | 92.2 | 82.7 | 84.2 | 67.5 | 87.5 | 169.9 | 97.3 | 14.9 |
| | | 12 | — | 61.9 | 62.0 | 57.8 | 74.1 | 129.4 | 77 | 13.4 |
| | 15 | -3 | 104.6 | 103.4 | 135.6 | — | 56.4 | — | 100 | 16.3 |
| | | 4 | 16.7 | 25.9 | 16.1 | — | 15.8 | — | 18.6 | 2.4 |
| | | 8 | 28.2 | 31.3 | 37.3 | — | 11.9 | — | 27.2 | 5.4 |
| | | 12 | 30.6 | 36.0 | 47.4 | — | 11.8 | — | 31.5 | 7.4 |
| | 18 | -3 | 89.2 | 69.9 | 106.5 | 104.6 | 129.7 | — | 100 | 9.9 |
| | | 4 | 24.2 | 28.6 | 27.6 | 35.4 | 37.6 | — | 30.7 | 2.5 |
| | | 8 | 21.3 | 35.2 | 36.3 | 22.8 | 33.7 | — | 29.9 | 3.2 |
| | | 12 | 26.4 | 50.3 | 47.4 | 29.7 | 59.4 | — | 42.7 | 6.3 |
| | 19 | -3 | 87.0 | 79.2 | 73.3 | 108.9 | 151.6 | — | 100 | 14.2 |
| | | 4 | 83.5 | 45.5 | 45.9 | 46.5 | 71 | — | 58.5 | 7.9 |
| | | 8 | 48.1 | 55.9 | 34.4 | 36.7 | 70.4 | — | 49.1 | 6.6 |
| | | 12 | — | — | — | — | — | — | — | — |
| | 40 | -3 | 77.2 | 93.0 | 109.5 | 104.4 | 116 | — | 100 | 6.8 |
| | | 4 | 36.4 | 50.8 | 40.2 | 51.3 | 25.6 | — | 40.9 | 4.8 |
| | | 8 | 35.0 | 38.7 | 36.4 | 37.5 | 26.8 | — | 34.9 | 2.1 |
| | | 12 | 33.3 | 13.2 | 54.0 | 59.5 | 42.7 | — | 40.6 | 8.2 |
| | 41 | 3 | 77.5 | 128.5 | 127.9 | 101.8 | 64.3 | — | 100 | 13 |
| | | 4 | 31.6 | 22.9 | 29.1 | 30.7 | 20.3 | — | 26.9 | 2.2 |
| | | 8 | 30.2 | 26.3 | 34.8 | 37.9 | 39.6 | — | 33.8 | 2.5 |
| | | 12 | 23.2 | 35.3 | 36.6 | 42.9 | 45.5 | — | 36.7 | 3.9 |
| | 46 | -3 | 69.3 | 93.3 | 99.5 | 119.4 | 118.5 | — | 100 | 9.2 |
| | | 4 | 13.0 | 21.2 | 14.5 | 28.6 | 35.7 | — | 22.6 | 4.3 |
| | | 8 | 22.0 | 58.4 | 29.2 | 17.1 | 98.4 | — | 45.0 | 15.2 |
| | | 12 | 48.5 | 51.9 | 38.1 | 49.7 | 112.9 | — | 60.2 | 13.4 |
| | 47 | -3 | 131.3 | 73.4 | 133.9 | 88.5 | 72.9 | — | 100.0 | 13.6 |
| | | 4 | 29.2 | 18.1 | 4.9 | 10.3 | 19.8 | — | 16.5 | 4.2 |
| | | 8 | 44.8 | 29.1 | 8.1 | 15.2 | 36 | — | 26.7 | 6.7 |
| | | 12 | 96.1 | 17.7 | 36.7 | 25.5 | 82.7 | — | 51.7 | 15.8 |
| | 49 | -3 | 139.7 | 85.0 | 69.1 | 91.8 | 114.4 | — | 100.0 | 12.3 |
| | | 4 | 55.1 | 73.4 | 40.0 | 33.6 | 57.5 | — | 51.9 | 7 |
| | | 8 | 51.6 | 51.4 | 30.2 | 52.0 | 59.0 | — | 48.8 | 4.9 |
| | | 12 | — | — | — | — | — | — | — | — |

In addition to the above, RNA-seq of liver biopsies at Day 28 shows that GalXC-APOC3-47 is the most potent test article for knockdown of APOC3 mRNA (23.4% remaining) followed by GalXC-APOC3-46 (27.3% remaining), GalXC-15 (B, 34.4% remaining), GalXC-41 (38.4% remaining), and GalXC-18 (43.0% remaining). As shown in Table 14, GalXC-APOC3-15, GalXC-APOC3-18, GalXC-APOC3-46, and GalXC-APOC3-47 show only small overall changes in the liver transcriptome; whereas, GalXC-APOC3-41 shows changes in the expression of more genes. No GalXC guide-to-mRNA hybridization-based off-target effects except APOC3-41 are identified by this RNA-seq study.

TABLE 14

Percentage of APOC3 mRNA Remaining at Day 28 and Number of Differentially Expressed Genes (compared to time-matched PBS)

| GalXC-APOC3 | APOC3 (% remaining) | Genes With Higher Expression | Genes With Lower Expression |
|---|---|---|---|
| 15 | 34.4 | 1 | 18 |
| 18 | 43 | 0 | 1 |
| 19 | 100.5 | 1 | 1 |
| 40 | 64.4 | 1 | 1 |
| 41 | 38.4 | 221 | 234 |
| 46 | 27.3 | 17 | 6 |
| 47 | 23.4 | 10 | 9 |
| 49 | 107.8 | 1 | 1 |

Taken together, these results show that GalXC-APOC3 oligonucleotides designed to target human APOC3 mRNA inhibit APOC3 expression in vivo (as determined by the reduction of the amount of APOC3 mRNA and APOC3 protein in treated animals).

SEQUENCES

The following nucleic acid sequences and/or amino acid sequences are referred to in the disclosure and are provided below for reference.

wild-type human APOC3 (535 bp; NCBI Ref. Seq. No. NM_000040.3)

SEQ ID NO: 1 ctgctcagttcatccctagaggcagctgctccaggaacagaggtgccatg cagccccgggtactccttgttgttgccctcctggcgctcctggcctctgc ccgagcttcagaggccgaggatgcctcccttctcagcttcatgcagggtt acatgaagcacgccaccaagaccgccaaggatgcactgagcagcgtgcag gagtcccaggtggcccagcaggccaggggctgggtgaccgatggcttcag ttccctgaaagactactggagcaccgttaaggacaagttctctgagttct gggatttggaccctgaggtcagaccaacttcagccgtggctgcctgagac ctcaataccccaagtccacctgcctatccatcctgcgagctccttgggtc

```
ctgcaatctccagggctgcccctgtaggttgcttaaaagggacagtattc tcagtgctctctaccccacctcatgcctggccccctccaggcatgctg gcctcccaataaagctggacaagaagctgctatga
``` wild-type human APOC3 (99 aa; NCBI Ref.
Seq. No. NP_079501.2)

SEQ ID NO: 2
MQPRVLLVVALLALLASARASEAEDASLLSFMQGYMKHATKTAKDALSSV
QESQVAQQARGWVTDGFSSLKDYWSTVKDKFSEFWDLDPEVRPTSAVAA mouse APOC3 (631 bp; NCBI Ref. Seq. No.
NM_001289755.1)

SEQ ID NO: 3
```
gcctgctcagttttatccctagaagcagctagctactccaggtaatgccc ctggggaggagaggaaggaagggaagaaacaaagagctggagggagaagc tctcaccacccagccatctagcccacagaaggcttgggactcatggtacg taggtgccatgcagccccgacgctcctcactgtggccctcttggctctc ctggcatctgcccgagctgaagaggtagagggatccttgctgctgggctc tgtacagggctacatggaacaagcctccaagacggtccaggatgcgctaa gtagcgtgcaggagtccgatatagctgtggtggccaggggctggatggac aatcacttcagatccctgaaaggctactggagcaagtttactgacaagtt caccggcttctgggattctaaccctgaggaccaaccaactccagctattg agtcgtgagacttctgtgttgcagatgtgcctgttcctccatcctgctgc cccccctccaggcctgccaggtggcccctgaaggttgctttaaggggaaag tatgttctcatgtcttcacccctccctagatctcacctaaacatgctgtc cctaataaagctggataagaagctgctgtta
``` mouse APOC3 (99 aa; NCBI Ref. Seq. No.
NP_001276684.1)

SEQ ID NO: 4
MQPRTLLTVALLALLASARAEEVEGSLLLGSVQGYMEQASKTVQDALSSV
QESDIAVVARGWMDNHFRSLKGYWSKFTDKFTGFWDSNPEDQPTPAIES rat APOC3 (579 bp; NCBI Ref. Seq. No.
NM_001271053)

SEQ ID NO: 5
```
atgcccctggggaggagaggaagggagggaggagacagagagaagacgct ctggccactcagccagctagcctacagaatgcttggaattcatggcctcc acccttgggttcctggtgcacaggtgccatgcagccccgaatgctcctca tcgtggcccctcgtggctctcctggcctctgcccgagctgatgagggagg ggatccttgctgctgggctctatgcagggctacatggaacaagcctccaa gacggtccaggatgcactaagcagcatgcaggagtctgatatagctgtgg tggccaggggctggatggacaatcgcttcaaatccctgaaaggctactgg agcaagttcactgataagttcactggcctctgggagtctggccctgagga ccaactaacaacaccaactcttgagccgtgagacctccatgttccagatg tgtctggccatctatcctgctgcctccgaaggttgctctaaggggaaagt atattctcatgcctttatccctcccagacctcacctaaacatgctgtcc ctaataaagctggacacgaagctgccatg
``` rat APOC3 (100 aa; NCBI Ref. Seq. No.
NP_001257982.1)

SEQ ID NO: 6
MQPRMLLIVALVALLASARADEGEGSLLLGSMQGYMEQASKTVQDALSSM
QESDIAVVARGWMDNRFKSLKGYWSKFTDKFTGLWESGPEDQLTTPTLEP primate APOC3 (567 bp; NCBI Ref. Seq.
No. XM_005579730.1)

SEQ ID NO: 7
```
aatataaaacaggtcagaaccctcctgcctgcctgctctgttcatcccta gaggcagctgctccaggaacagaggcgccatgcagcccgggtactcctt gttgctgccctgctgtcactcctggcctctgccagagcttcagaggccga ggacacctcccttcttggcttcatgcagggctacatgcagcatgccacca agaccgccaaggatgcactgaccagcgtccaggagtcccaggtggcccag caggccagaggctgggtgaccgatggcttcagttccctgaaagactactg gagcaccgttaaggacaagttatctgggttctgggatttgaaccctgagg ccaaacccactctggctgaggctgcctgagacctcaataccccaagtcca cctgcctgtccatcctgccagctccttgggtcctgcagcctccagggctg cccctgtaggttgcttaaagggacagtattctcagtgccctcctaccgc acctcatgcctggccccctccaggcagggtgtcctcccaataaagctgg acaagaagctgctatga
``` primate APOC3 (99 aa; NCBI Ref. Seq. No.
XP_005579787.1)

SEQ ID NO: 8
MQPRVLLVAALLSLLASARASEAEDTSLLGFMQGYMQHATKTAKDALTSV
QESVAQQARGWVTDGFSSLKDYWSTVKDKLSGFWDLNPEAKPTLAEAA

SEQ ID NOs:9-170: GalXC-APOC3 Oligonucleotides
(unmodified)

| GalXC-APOC3 | Sense Strand (passenger; 36-mer) | SEQ ID NO: | Antisense Strand (guide; 22-mer) | SEQ ID NO: |
|---|---|---|---|---|
| 1 | CUAGAGGCAGCUGCUCCAGAGCAGCCGAAAGGCUGC | 9 | UCUGGAGCAGCUGCCUCUAGGG | 10 |
| 2 | GGUACUCCUUGUUGUUGCCAGCAGCCGAAAGGCUGC | 11 | UGGCAACAACAAGGAGUACCGG | 12 |
| 3 | GAGGCCGAGGAUGCCUCCCAGCAGCCGAAAGGCUGC | 13 | UGGGAGGCAUCCUCGGCCUCGG | 14 |
| 4 | CCUUCUCAGCUUCAUGCAGAGCAGCCGAAAGGCUGC | 15 | UCUGCAUGAAGCUGAGAAGGGG | 16 |
| 5 | CUUCUCAGCUUCAUGCAGGAGCAGCCGAAAGGCUGC | 17 | UCCUGCAUGAAGCUGAGAAGGG | 18 |
| 6 | CUCAGCUUCAUGCAGGGUUAGCAGCCGAAAGGCUGC | 19 | UAACCCUGCAUGAAGCUGAGGG | 20 |
| 7 | AUGCACUGAGCAGCGUGCAAGCAGCCGAAAGGCUGC | 21 | UUGCACGCUGCUCAGUGCAUGG | 22 |
| 8 | UGCACUGAGCAGCGUGCAGAGCAGCCGAAAGGCUGC | 23 | UCUGCACGCUGCUCAGUGCAGG | 24 |

-continued

| GalXC-APOC3 | Sense Strand (passenger; 36-mer) | SEQ ID NO: | Antisense Strand (guide; 22-mer) | SEQ ID NO: |
|---|---|---|---|---|
| 9 | CUGAGCAGCGUGCAGGAGUAGCAGCCGAAAGGCUGC | 25 | UACUCCUGCACGCUGCUCAGGG | 26 |
| 10 | AGCAGCGUGCAGGAGUCCCAGCAGCCGAAAGGCUGC | 27 | UGGGACUCCUGCACGCUGCUGG | 28 |
| 11 | UGCAGGAGUCCCAGGUGGCAGCAGCCGAAAGGCUGC | 29 | UGCCACCUGGGACUCCUGCAGG | 30 |
| 12 | GGGGCUGGGUGACCGAUGGAGCAGCCGAAAGGCUGC | 31 | UCCAUCGGUCACCCAGCCCCGG | 32 |
| 13 | GGCUUCAGUUCCCUGAAAGAGCAGCCGAAAGGCUGC | 33 | UCUUUCAGGGAACUGAAGCCGG | 34 |
| 14 | CUUCAGUUCCCUGAAGACAGCAGCCGAAAGGCUGC | 35 | UGUCUUUCAGGGAACUGAAGGG | 36 |
| 15 | UUCAGUUCCCUGAAAGACUAGCAGCCGAAAGGCUGC | 37 | UAGUCUUUCAGGGAACUGAAGG | 38 |
| 16 | AGACUACUGGAGCACCGUUAGCAGCCGAAAGGCUGC | 39 | UAACGGUGCUCCAGUAGUCUGG | 40 |
| 17 | UACUGGAGCACCGUUAAGAGCAGCCGAAAGGCUGC | 41 | UCCUUAACGGUGCUCCAGUAGG | 42 |
| 18 | UGGAGCACCGUUAAGGACAAGCAGCCGAAAGGCUGC | 43 | UUGUCCUUAACGGUGCUCCAGG | 44 |
| 19 | ACCGUUAAGGACAAGUUCUAGCAGCCGAAAGGCUGC | 45 | UAGAACUUGUCCUUAACGGUGG | 46 |
| 20 | CCGUUAAGGACAAGUUCUCAGCAGCCGAAAGGCUGC | 47 | UGAGAACUUGUCCUUAACGGGG | 48 |
| 21 | CGUUAAGGACAAGUUCUCUAGCAGCCGAAAGGCUGC | 49 | UAGAGAACUUGUCCUUAACGGG | 50 |
| 22 | GUUAAGGACAAGUUCUCUGAGCAGCCGAAAGGCUGC | 51 | UCAGAGAACUUGUCCUUAACGG | 52 |
| 23 | AGGACAAGUUCUCUGAGUUAGCAGCCGAAAGGCUGC | 53 | UAACUCAGAGAACUUGUCCUGG | 54 |
| 24 | AGGACAAGUUCUCUGAGUUAGCAGCCGAAAGGCUGC | 55 | UAACUCAGAGAACUUGUCCUGG | 56 |
| 25 | UGCCUGAGACCUCAAUACCAGCAGCCGAAAGGCUGC | 57 | UGGUAUUGAGGUCUCAGGCAGG | 58 |
| 26 | CCCCAAGUCCACCUGCCUAGCAGCCGAAAGGCUGC | 59 | UUAGGCAGGUGGACUUGGGGGG | 60 |
| 27 | CCCAAGUCCACCUGCCUAUAGCAGCCGAAAGGCUGC | 61 | UAUAGGCAGGUGGACUUGGGGG | 62 |
| 28 | CAAGUCCACCUGCCUAUCCAGCAGCCGAAAGGCUGC | 63 | UGGAUAGGCAGGUGGACUUGGG | 64 |
| 29 | AAGUCCACCUGCCUAUCCAAGCAGCCGAAAGGCUGC | 65 | UUGGAUAGGCAGGUGGACUUGG | 66 |
| 30 | AGUCCACCUGCCUAUCCAUAGCAGCCGAAAGGCUGC | 67 | UAUGGAUAGGCAGGUGGACUGG | 68 |
| 31 | GUCCACCUGCCUAUCCAUCAGCAGCCGAAAGGCUGC | 69 | UGAUGGAUAGGCAGGUGGACGG | 70 |
| 32 | UCCACCUGCCUAUCCAUCCAGCAGCCGAAAGGCUGC | 71 | UGGAUGGAUAGGCAGGUGGAGG | 72 |
| 33 | CCACCUGCCUAUCCAUCCUAGCAGCCGAAAGGCUGC | 73 | UAGGAUGGAUAGGCAGGUGGG | 74 |
| 34 | CACCUGCCUAUCCAUCCUGAGCAGCCGAAAGGCUGC | 75 | UCAGGAUGGAUAGGCAGGUGGG | 76 |
| 35 | CCUGCCUAUCCAUCCUGCGAGCAGCCGAAAGGCUGC | 77 | UCGCAGGAUGGAUAGGCAGGGG | 78 |
| 36 | UCCAUCCUGCGAGCUCCUUAGCAGCCGAAAGGCUGC | 79 | UAAGGAGCUCGCAGGAUGGAGG | 80 |
| 37 | CAUCCUGCGAGCUCCUUGGAGCAGCCGAAAGGCUGC | 81 | UCCAAGGAGCUCGCAGGAUGGG | 82 |
| 38 | AUCCUGCGAGCUCCUUGGGAGCAGCCGAAAGGCUGC | 83 | UCCCAAGGAGCUCGCAGGAUGG | 84 |
| 39 | UCCUGCGAGCUCCUUGGGUAGCAGCCGAAAGGCUGC | 85 | UACCCAAGGAGCUCGCAGGAGG | 86 |
| 40 | GCUGCCCUGUAGGUUGCUAGCAGCCGAAAGGCUGC | 87 | UAGCAACCUACAGGGGCAGCGG | 88 |
| 41 | GUAGGUUGCUUAAAAGGGAAGCAGCCGAAAGGCUGC | 89 | UUCCCUUUUAAGCAACCUACGG | 90 |
| 42 | UAGGUUGCUUAAAAGGGACAGCAGCCGAAAGGCUGC | 91 | UGUCCCUUUUAAGCAACCUAGG | 92 |
| 43 | UUGCUUAAAAGGGACAGUAAGCAGCCGAAAGGCUGC | 93 | UUACUGUCCCUUUUAAGCAAGG | 94 |
| 44 | UGCUUAAAAGGGACAGUAUAGCAGCCGAAAGGCUGC | 95 | UAUACUGUCCCUUUUAAGCAGG | 96 |

| GalXC-APOC3 | Sense Strand (passenger; 36-mer) | SEQ ID NO: | Antisense Strand (guide; 22-mer) | SEQ ID NO: |
|---|---|---|---|---|
| 45 | GCUUAAAAGGGACAGUAUUAGCAGCCGAAAGGCUGC | 97 | UAAUACUGUCCCUUUUAAGCGG | 98 |
| 46 | CUUAAAAGGGACAGUAUUCAGCAGCCGAAAGGCUGC | 99 | UGAAUACUGUCCCUUUUAAGGG | 100 |
| 47 | AAAAGGGACAGUAUUCUCAAGCAGCCGAAAGGCUGC | 101 | UUGAGAAUACUGUCCCUUUUGG | 102 |
| 48 | GGACAGUAUUCUCAGUGCUAGCAGCCGAAAGGCUGC | 103 | UAGCACUGAGAAUACUGUCCGG | 104 |
| 49 | GACAGUAUUCUCAGUGCUCAGCAGCCGAAAGGCUGC | 105 | UGAGCACUGAGAAUACUGUCGG | 106 |
| 50 | CAGUAUUCUCAGUGCUCUCAGCAGCCGAAAGGCUGC | 107 | UGAGAGCACUGAGAAUACUGGG | 108 |
| 51 | UAAAGCUGGACAAGAAGCUAGCAGCCGAAAGGCUGC | 109 | UAGCUUCUUGUCCAGCUUUAGG | 110 |
| 52 | AAAGCUGGACAAGAAGCUGAGCAGCCGAAAGGCUGC | 111 | UCAGCUUCUUGUCCAGCUUUGG | 112 |
| 53 | CUGUCCCUAAUAAAGCUGGAGCAGCCGAAAGGCUGC | 113 | UCCAGCUUUAUUAGGGACAGGG | 114 |
| 54 | AGCUUCAUGCAGGGUUACAAGCAGCCGAAAGGCUGC | 115 | UUGUAACCCUGCAUGAAGCUGG | 116 |
| 55 | CUGGAGCACCGUUAAGGACAGCAGCCGAAAGGCUGC | 117 | UGUCCUUAACGGUGCUCCAGGG | 118 |
| 56 | GCACCGUUAAGGACAAGUUAGCAGCCGAAAGGCUGC | 119 | UAACUUGUCCUUAACGGUGCGG | 120 |
| 57 | UGUAGGUUGCUUAAAAGGGAGCAGCCGAAAGGCUGC | 121 | UCCCUUUUAAGCAACCUACAGG | 122 |
| 58 | GUUGCUUAAAGGGACAGUAGCAGCCGAAAGGCUGC | 123 | UACUGUCCCUUUUAAGCAACGG | 124 |
| 59 | GAGCACCGUUAAGGACAAGAGCAGCCGAAAGGCUGC | 125 | UCUUGUCCUUAACGGUGCUCGG | 126 |
| 60 | AGCACCGUUAAGGACAAGUAGCAGCCGAAAGGCUGC | 127 | UACUUGUCCUUAACGGUGCUGG | 128 |
| 61 | CUGUAGGUUGCUUAAAAGGAGCAGCCGAAAGGCUGC | 129 | UCCUUUUAAGCAACCUACAGG | 130 |
| 62 | AGGUUGCUUAAAAGGGACAAGCAGCCGAAAGGCUGC | 131 | UUGUCCCUUUUAAGCAACCUGG | 132 |
| 63 | GGUUGCUUAAAAGGGACAGAGCAGCCGAAAGGCUGC | 133 | UCUGUCCCUUUUAAGCAACCGG | 134 |
| 64 | CCAAUAAAGCUGGACAAGAAGCAGCCGAAAGGCUGC | 135 | UUCUUGUCCAGCUUUAUUGGGG | 136 |
| 65 | AUGGCUUCAGUUCCCUGAAAGCAGCCGAAAGGCUGC | 137 | UUUCAGGGAACUGAAGCCAUGG | 138 |
| 66 | GCUUCAGUUCCCUGAAAGAAGCAGCCGAAAGGCUGC | 139 | UUCUUUCAGGGAACUGAAGCGG | 140 |
| 67 | CAGUUCCCUGAAAGACUACAGCAGCCGAAAGGCUGC | 141 | UGUAGUCUUUCAGGGAACUGGG | 142 |
| 68 | AGUUCCCUGAAAGACUACUAGCAGCCGAAAGGCUGC | 143 | UAGUAGUCUUUCAGGGAACUGG | 144 |
| 69 | CCUGAAAGACUACUGGAGCAGCAGCCGAAAGGCUGC | 145 | UGCUCCAGUAGUCUUUCAGGGG | 146 |
| 70 | GAAAGACUACUGGAGCACCAGCAGCCGAAAGGCUGC | 147 | UGGUGCUCCAGUAGUCUUUCGG | 148 |
| 71 | GACUACUGGAGCACCGUUAAGCAGCCGAAAGGCUGC | 149 | UUAACGGUGCUCCAGUAGUCGG | 150 |
| 72 | ACUGGAGCACCGUUAAGGAAGCAGCCGAAAGGCUGC | 151 | UUCCUUAACGGUGCUCCAGUGG | 152 |
| 73 | GGAGCACCGUUAAGGACAAAGCAGCCGAAAGGCUGC | 153 | UUUGUCCUUAACGGUGCUCCGG | 154 |
| 74 | GCUUCAUGCAGGGUUACAUAGCAGCCGAAAGGCUGC | 155 | UAUGUAACCCUGCAUGAAGCGG | 156 |
| 75 | CACCGUUAAGGACAAGUUCAGCAGCCGAAAGGCUGC | 157 | UGAACUUGUCCUUAACGGUGGG | 158 |
| 76 | ACAAGUUCUCUGAGUUCUGAGCAGCCGAAAGGCUGC | 159 | UCAGAACUCAGAGAACUUGUGG | 160 |
| 77 | AAGUUCUCUGAGUUCUGGGAGCAGCCGAAAGGCUGC | 161 | UCCCAGAACUCAGAGAACUUGG | 162 |
| 78 | AGUUCUCUGAGUUCUGGGAAGCAGCCGAAAGGCUGC | 163 | UUCCCAGAACUCAGAGAACUGG | 164 |
| 79 | GUUCUCUGAGUUCUGGGAUAGCAGCCGAAAGGCUGC | 165 | UAUCCCAGAACUCAGAGAACGG | 166 |
| 80 | GGACCCUGAGGUCAGACCAAGCAGCCGAAAGGCUGC | 167 | UUGGUCUGACCUCAGGGUCCGG | 168 |

SEQ ID NOs:171-332: GalXC-APOC3 Oligonucleotides (modified)

| GalXC-APOC3 | Sense Strand (passenger; 36-mer) | SEQ ID NO: | Antisense Strand (guide; 22-mer) | SEQ ID NO: |
|---|---|---|---|---|
| 81 | GUAUUCUCAGUGCUCUCCUAGCAGCCGAAAGGCUGC | 169 | UAGGAGAGCACUGAGAAUACGG | 170 |
| 1 | [mCs][mU][mA][mG][mA][mG][mG][fC][fA][mU][mC][mA][mG][mA][mG][mC][mA][mG][mC][mC][mG][ademA-GalNAc][ademA-GalNAc][ademA-GalNAc][mG][mC][mU][mG][mC] | 171 | [MePhosphonate-40-mUs][fCs][fUs][fG][fG][mA][fG][mC][mA][fG][mC][mU][mC][mU][mA][mGs][mGs][mG] | 172 |
| 2 | [mGs][mG][mU][mA][mC][mU][mC][fC][fU][fU][fG][mU][mU][mG][mU][mU][mG][mC][mC][mA][mC][mA][mG][mC][mC][mG][ademA-GalNAc][ademA-GalNAc][ademA-GalNAc][mG][mG][mC][mU][mG][mC] | 173 | [MePhosphonate-40-mUs][fGs][fGs][fC][fA][mA][fC][mA][mA][fG][mA][mG][mU][mA][mC][mCs][mGs][mG] | 174 |
| 3 | [mGs][mA][mG][mG][mC][mC][mG][fA][fG][fG][fA][mU][mG][mC][mC][mU][mC][mC][mC][mA][mG][mC][mC][mG][ademA-GalNAc][ademA-GalNAc][ademA-GalNAc][mG][mG][mC][mU][mG][mC] | 175 | [MePhosphonate-40-mUs][fGs][fGs][fC][fA][mA][fC][mA][mA][fG][mA][mG][mU][mA][mC][mCs][mGs][mG] | 176 |
| 4 | [mCs][mC][mU][mU][mC][mU][mU][mC][fA][fG][mU][mG][mC][mA][mG][mA][mG][mC][mA][mG][mC][mC][mG][ademA-GalNAc][ademA-GalNAc][ademA-GalNAc][mG][mG][mC][mU][mG][mC] | 177 | [MePhosphonate-40-mUs][fCs][fUs][fG][fC][mA][fU][mG][mA][fA][mG][mC][mU][fG][mA][mGs][mGs][mG] | 178 |
| 5 | [mCs][mU][mU][mC][mU][mC][mA][fG][fC][fU][fU][mC][mC][mA][mG][mG][mA][mG][mA][mG][mC][mA][mG][mC][mC][mG][ademA-GalNAc][ademA-GalNAc][ademA-GalNAc][mG][mG][mC][mU][mG][mC] | 179 | [MePhosphonate-40-mUs][fCs][fCs][fU][fG][mC][fA][mU][mG][fA][mA][mG][mC][fU][mG][mAs][mGs][mG] | 180 |
| 6 | [mCs][mU][mC][mA][mG][mC][mU][fU][fC][fA][fU][mG][mA][mG][mG][mG][mU][mU][mA][mG][mC][mA][mG][mC][mG][ademA-GalNAc][ademA-GalNAc][ademA-GalNAc][mG][mG][mC][mU][mG][mC] | 181 | [MePhosphonate-40-mUs][fAs][fAs][fC][fC][mC][fU][mG][mC][mA][fU][mA][fA][mG][mC][mU][mG][mA][mGs][mGs][mG] | 182 |
| 7 | [mAs][mU][mG][mC][mA][mC][mU][fG][fA][mG][mU][mG][mC][mA][mA][mG][mC][mA][mG][mC][mC][mG][ademA-GalNAc][ademA-GalNAc][ademA-GalNAc][mG][mG][mC][mU][mG][mC] | 183 | [MePhosphonate-40-mUs][fUs][fGs][fC][fA][mC][fG][mC][mU][fG][mC][mU][fA][mG][mU][mG][mC][mA][mUs][mGs][mG] | 184 |
| 8 | [mUs][mG][mC][mA][mC][mU][mG][fA][fG][fC][fA][mG][mC][mU][mG][mC][mA][mA][mG][mC][mA][mG][mC][mC][mG][ademA-GalNAc][ademA-GalNAc][ademA-GalNAc][mG][mG][mC][mU][mG][mC] | 185 | [MePhosphonate-40-mUs][fCs][fUs][fG][fC][mA][fC][mG][mC][fU][mG][mC][mU][fC][mA][mG][mU][mG][mC][mAs][mGs][mG] | 186 |
| 9 | [mCs][mU][mG][mA][mG][mC][mA][fG][fC][fG][fU][mG][mC][mA][mG][mG][mA][mU][mA][mG][mC][mA][mG][mC][mC][mG][ademA-GalNAc][ademA-GalNAc][ademA-GalNAc][mG][mG][mC][mU][mG][mC] | 187 | [MePhosphonate-40-mUs][fAs][fCs][fU][fC][mC][fU][mG][mC][fA][mC][mG][mC][fU][mG][mC][mU][mC][mA][mGs][mGs][mG] | 188 |
| 10 | [mAs][mG][mC][mA][mG][mC][mG][fU][fG][fC][fA][mU][mG][mA][mG][mU][mC][mC][mC][mA][mG][mC][mA][mG][mC][mG][ademA-GalNAc][ademA-GalNAc][ademA-GalNAc][mG][mG][mC][mU][mG][mC] | 189 | [MePhosphonate-40-mUs][fGs][fGs][fG][fA][mC][fU][mC][mC][mU][mG][mC][mA][fC][mG][mC][mU][mG][mC][mUs][mGs][mG] | 190 |
| 11 | [mUs][mG][mC][mA][mG][mG][mA][fG][fU][fC][mC][mC][mA][mG][mG][mG][mG][mC][mA][mG][mC][mA][mG][mC][mC][mG][ademA-GalNAc][ademA-GalNAc][ademA-GalNA | 191 | [MePhosphonate-40-mUs][fGs][fCs][fC][fA][mC][fC][mU][mG][fG][mG][mA][mC][fU][mC][mC][mU][mG][mC][mAs][mGs][mG] | 192 |

| GalXC-APOC3 | Sense Strand (passenger; 36-mer) | SEQ ID NO: | Antisense Strand (guide; 22-mer) | SEQ ID NO: |
|---|---|---|---|---|
| | c][mG][mG][mC][mU][mG][mC] | | | |
| 12 | [mGs][mG][mG][mG][mC][mU][mG][fG][fG][fU][fG][mA][mC][mC][mG][mA][mU][mG][mA][mG][mG][mG][mA][mG][mC][mC][mG][ademA-GalNAc][ademA-GalNAc][ademA-GalNAc][mG][mG][mC][mU][mG][mC] | 193 | [MePhosphonate-4O-mUs][fG][mG][mU][fC][mA][mC][mC][fC][mA][mG][mC][mC][mC][mCs][mGs][mG] | 194 |
| 13 | [mGs][mG][mC][mU][mU][mC][mA][fG][fU][fU][fC][mC][mC][mU][mG][mA][mA][mA][mG][mA][mA][mC][mA][mG][mC][mC][mG][ademA-GalNAc][ademA-GalNAc][ademA-GalNAc][mG][mG][mC][mU][mG][mC] | 195 | [MePhosphonate-4O-mUs][fA][mG][mG][fG][mA][mA][mC][fU][mG][mA][mA][mG][mC][mCs][mGs][mG] | 196 |
| 14 | [mCs][mU][mU][mC][mA][mG][mU][fU][fC][fC][fC][mU][mG][mA][mA][mA][mG][mA][mA][mC][mA][mG][mC][mC][mG][ademA-GalNAc][ademA-GalNAc][ademA-GalNAc][mG][mG][mC][mU][mG][mC] | 197 | [MePhosphonate-4O-mUs][fGs][fUs][fC][fU][mU][fU][mC][mA][fG][mG][mG][mA][fA][mC][mU][mG][mA][m][mGs][mG] | 198 |
| 15 | [mUs][mU][mC][mA][mG][mU][mU][fC][fC][fC][fU][mG][mA][mA][mA][mG][mA][mA][mC][mA][mG][mC][mC][mG][ademA-GalNAc][ademA-GalNAc][ademA-GalNAc][mG][mG][mC][mU][mG][mC] | 199 | [MePhosphonate-4O-mUs][fAs][fGs][fU][fC][mU][fU][mU][mC][fA][mG][mG][mG][fA][mA][mC][mU][mG][mA][mAs][mGs][mG] | 200 |
| 16 | [mAs][mG][mA][mC][fG][fA][mG][mC][mA][mC][mC][mG][mU][mU][mA][mG][mC][mA][mC][mC][mG][ademA-GalNAc][ademA-GalNAc][ademA-GalNAc][mG][mG][mC][mU][mG][mC] | 201 | [MePhosphonate-4O-mUs][fAs][fAs][fC][fG][mG][fU][mG][mC][fU][mC][mC][mA][fG][mG][mA][mG][mU][mC][mUs][mGs][mG] | 202 |
| 17 | [mUs][mA][mC][mU][mG][mG][mU][mG][mA][f][fU][fA][fC][mG][mU][mU][mA][mA][mG][mG][mA][mG][mC][mA][mG][mC][mC][mG][ademA-GalNAc] | 203 | [MePhosphonate-4O-mUs][fCs][fCs][fU][fU][mA][fA][mC][mG][mU][fA][mC][mA][mG][mU][mC][mC][mA][mG][mU][mAs][mGs][mG] | 204 |
| | [ademA-GalNAc][ademA-GalNAc][mG][mG][mC][mU][mG][mC] | | | |
| 18 | [mUs][mG][mG][mA][mG][mC][mA][fC][fC][fG][fU][mU][mA][mA][mG][mA][mA][mA][mG][mC][mA][mG][mC][mC][mG][ademA-GalNAc][ademA-GalNAc][ademA-GalNAc][mG][mG][mC][mU][mG][mC] | 205 | [MePhosphonate-4O-mUs][fUs][fGs][fU][fC][mC][fU][mU][mA][fA][mC][mG][mG][fU][mG][mC][mU][mC][mC][mAs][mGs][mG] | 206 |
| 19 | [mAs][mC][mC][mG][mU][mU][mA][fA][fG][fA][fA][mA][mG][mU][mU][mC][mU][mA][mG][mC][mA][mG][mC][mC][mG][ademA-GalNAc][ademA-GalNAc][ademA-GalNAc][mG][mG][mC][mU][mG][mC] | 207 | [MePhosphonate-4O-mUs][fAs][fGs][fA][fA][mC][fU][mU][mG][fU][mC][mU][fU][mA][mA][mC][mG][mG][mUs][mGs][mG] | 208 |
| 20 | [mCs][mC][mG][mU][mU][mA][mA][fG][fA][fC][mA][mA][mG][mU][mU][mC][mU][mA][mG][mC][mA][mG][mC][mC][mG][ademA-GalNAc][ademA-GalNAc][ademA-GalNAc][mG][mG][mC][mU][mG][mC] | 209 | [MePhosphonate-4O-mUs][fGs][fAs][fG][fA][mA][fC][mU][mU][fG][mU][mC][mC][fU][mU][mA][mA][mC][mG][mGs][mGs][mG] | 210 |
| 21 | [mCs][mG][mU][mU][mA][mA][mG][fG][fA][fC][fA][mA][mG][mU][mU][mC][mU][mA][mG][mC][mA][mG][mC][mC][mG][ademA-GalNAc][ademA-GalNAc][ademA-GalNAc][mG][mG][mC][mU][mG][mC] | 211 | [MePhosphonate-4O-mUs][fAs][fGs][fA][fG][mA][fA][mC][mU][fU][mG][mU][fC][mU][mU][mA][mA][mC][mGs][mGs][mG] | 212 |
| 22 | [mGs][mU][mU][mA][mA][mG][mG][fA][fC][fA][fA][mG][mU][mU][mC][mU][mG][mA][mG][mC][mA][mG][mC][mC][mG][ademA-GalNAc][ademA-GalNAc][ademA-GalNAc][mG][mG][mC][mU][mG][mC] | 213 | [MePhosphonate-4O-mUs][fCs][fAs][fG][fA][mG][fA][mA][mC][fU][mU][mG][mU][fC][mC][mU][mU][mA][mA][mCs][mGs][mG] | 214 |
| 23 | [mAs][mG][mG][mA][mC][mA][mA][fG][fU][mG][mA][mG][mU][mU][mA][m | 215 | [MePhosphonate-4O-mUs][fAs][fAs][fC][fU][mC][fA][mG][mA][fG][mA] | 216 |

| GalXC-APOC3 | Sense Strand (passenger; 36-mer) | SEQ ID NO: | Antisense Strand (guide; 22-mer) | SEQ ID NO: |
|---|---|---|---|---|
| | G][mC][mA][mG][mC][mC][mG][ademA-GalNAc][ademA-GalNAc][ademA-GalNAc][mG][mG][mC][mU][mG][mC] | | [mA][mC][fU][fU][mG][mU][mC][mC][mUs][mGs][mG] | |
| 24 | [mAs][mG][fG][mA][mC][mA][mA][fG][fU][fU][mC][fU][fC][mU][mG][mA][fG][mU][mU][mA][mG][mC][mU][mA][mG][mC][mC][prgA-peg-GalNAc][prgA-peg-GalNAc][prgA-peg-GalNAc][mG][mG][mC][mU][mG][mC] | 217 | [Phosphonate-40-mUs][fAs][fAs][mC][fU][mC][fA][fG][mA][fG][mA][fA][mC][fU][mU][fG][mU][mC][fC][mUs][mGs][mG] | 218 |
| 25 | [mUs][mG][mC][mC][mU][mG][mA][fG][fA][fC][fC][mU][mC][mA][mA][mU][mA][mC][mC][mA][mG][mC][mA][mG][mC][mC][mG][ademA-GalNAc][ademA-GalNAc][ademA-GalNAc][mG][mG][mC][mU][mG][mC] | 219 | [MePhosphonate-40-mUs][fGs][fGs][fU][fA][mU][fU][mG][mA][fG][mG][mU][mC][fU][mC][mA][mG][mG][mC][mAs][mGs][mG] | 220 |
| 26 | [mCs][mC][mC][mC][mA][mA][mG][fU][fC][fC][fA][mC][mC][mU][mG][mC][mC][mU][mA][mA][mG][mC][mA][mG][mC][mC][mG][ademA-GalNAc][ademA-GalNAc][ademA-GalNAc][mG][mG][mC][mU][mG][mC] | 221 | [MePhosphonate-40-mUs][fUs][fAs][fG][fG][mC][fA][mG][mG][mA][fC][mU][mU][mG][mG][mGs][mGs][mG] | 222 |
| 27 | [mCs][mC][mC][mA][mA][mG][mU][fC][fC][fA][fC][mC][mU][mG][mC][mC][mU][mA][mU][mA][mG][mC][mA][mG][mC][mC][mG][ademA-GalNAc][ademA-GalNAc][ademA-GalNAc][mG][mG][mC][mU][mG][mC] | 223 | [MePhosphonate-40-mUs][fAs][fUs][fA][fG][mG][fC][mA][mG][fG][mU][mG][mG][mA][fC][mU][mU][mG][mG][mGs][mGs][mG] | 224 |
| 28 | [mCs][mA][mA][mG][mU][mC][mC][fA][fC][fC][fU][mG][mC][mC][mU][mA][mU][mC][mC][mA][mG][mC][mA][mG][mC][mC][mG][ademA-GalNAc][ademA-GalNAc][ademA-GalNAc][mG][mG][mC][mU][mG][mC] | 225 | [MePhosphonate-40-mUs][fGs][fGs][fA][fU][mA][fG][mG][mC][fA][mG][mG][mU][fG][mG][mA][mC][mU][mU][mGs][mGs][mG] | 226 |
| 29 | [mAs][mA][mG][mU][mC][mC][mA][fC][fC][fU][fG][mC][mC][mU][mA][mU][mC][mC][mA][mA][mG][mC][mA][mG][mC][mC][mG][ademA-GalNAc][ademA-GalNAc][ademA-GalNAc][mG][mG][mC][mU][mG][mC] | 227 | [MePhosphonate-40-mUs][fUs][fGs][fG][fA][mU][fA][mG][mG][fC][mA][mG][mG][fU][mG][mG][mA][mC][mU][mUs][mGs][mG] | 228 |
| 30 | [mAs][mG][mU][mC][mC][mA][mC][fC][fU][fG][fC][mC][mU][mA][mU][mC][mC][mA][mA][mU][mA][mG][mC][mC][mA][mG][mC][mC][mG][ademA-GalNAc][ademA-GalNAc][ademA-GalNAc][mG][mG][mC][mU][mG][mC] | 229 | [MePhosphonate-40-mUs][fAs][fUs][fG][fG][mA][fU][mA][mG][fG][mC][mA][mG][mG][mU][mG][mG][mA][mC][mUs][mGs][mG] | 230 |
| 31 | [mGs][mU][mC][mC][mA][mC][mC][fU][fG][fC][fC][mU][mA][mU][mC][mC][mA][mU][mC][mA][mG][mC][mA][mG][mC][mC][mG][ademA-GalNAc]m[adeA-GalNAc][ademA-GalNAc][mG][mG][mC][mU][mG][mC] | 231 | [MePhosphonate-40-mUs][fGs][fAs][fU][fG][mG][fA][mU][mA][fG][mG][mC][mA][fG][mG][mU][mG][mG][mA][mCs][mGs][mG] | 232 |
| 32 | [mUs][mC][mC][mA][mC][mC][mU][fG][fC][fC][mU][mA][mU][mC][mC][mA][mG][mC][mA][mG][mC][mC][mG][ademA-GalNAc][ademA-GalNAc][ademA-GalNAc][mG][mG][mC][mU][mG][mC] | 233 | [MePhosphonate-40-mUs][fGs][fGs][fA][fU][mG][fG][mA][mU][fA][mG][mG][mC][fA][mG][mG][mU][mG][mG][mAs][mGs][mG] | 234 |
| 33 | [mCs][mC][mA][mC][mC][mU][mG][fC][fC][fU][fA][mU][mC][mC][mU][mA][mG][mC][mA][mG][mC][mC][mG][ademA-GalNAc][ademA-GalNAc][ademA-GalNAc][mG][mG][mC][mU][mG][mC] | 235 | [MePhosphonate-40-mUs][fAs][fGs][fG][fA][mU][fG][mG][mA][fU][mA][mG][mG][fC][mA][mG][mG][mU][mG][mGs][mGs][mG] | 236 |
| 34 | [mCs][mA][mC][mC][mU][mG][mC][fC][fU][fA][fU][mC][mC][mA][mU][mC][mA][mG][mC][mA][mG][mC][mC][mG][ademA-GalNAc][ademA-GalNAc][ademA-GalNAc] | 237 | [MePhosphonate-40-mUs][fCs][fAs][fG][fG][mA][fU][mG][mG][fA][mU][mA][mG][fG][mA][mG][mG][mU][mGs][mGs][mG] | 238 |

| GalXC-APOC3 | Sense Strand (passenger; 36-mer) | SEQ ID NO: | Antisense Strand (guide; 22-mer) | SEQ ID NO: |
|---|---|---|---|---|
| | [mG][mG][mC][mU][mG][mC] | | | |
| 35 | [mCs][mC][mU][mG][fC][fC][mA][mU][mC][mC][mU][mG][mC][mG][mA][mG][mC][mA][mG][mC][mC][mG][ademA-GalNAc][ademA-GalNAc][ademA-GalNAc][mG][mG][mC][mU][mG][mC] | 239 | [MePhosphonate-40-mUs][fCs][fGs][fC][fA][mG][fG][mA][mU][fG][mG][mA][mU][fA][mG][mG][mC][mA][mG][mGs][mGs][mG] | 240 |
| 36 | [mUs][mC][mC][mA][mU][mC][mC][fU][fG][fC][fG][mA][mG][mC][mU][mC][mC][mU][mU][mA][mG][mC][mA][mG][mC][mC][mG][ademA-GalNAc][ademA-GalNAc][ademA-GalNAc][mG][mG][mC][mU][mG][mC] | 241 | [MePhosphonate-40-mUs][fAs][fAs][fG][fG][mA][fG][mC][mU][fC][mG][mC][mA][fG][mG][mA][mU][mG][mG][mAs][mGs][mG] | 242 |
| 37 | [mCs][mA][mU][mC][mC][mU][mG][fC][fG][fA][fG][mC][mU][mC][mC][mU][mU][mG][mA][mG][mC][mA][mG][mC][mC][mG][ademA-GalNAc][ademA-GalNAc][ademA-GalNAc][mG][mG][mC][mU][mG][mC] | 243 | [MePhosphonate-O4-mUs][fCs][fCs][fA][fA][mG][fG][mA][mG][fC][mU][mC][mG][fC][mA][mG][mG][mA][mU][mGs][mGs][mG] | 244 |
| 38 | [mAs][mU][mC][mC][mU][mG][mC][fG][fA][fG][fC][mU][mC][mC][mU][mU][mG][mG][mG][mA][mG][mC][mA][mG][mC][mC][mG][ademA-GalNAc][ademA-GalNAc][ademA-GalNAc][mG][mG][mC][mU][mG][mC] | 245 | [MePhosphonate-40-mUs][fCs][fCs][fC][fA][mA][fG][mG][mA][fG][mC][mU][fC][mG][mC][mA][mG][mG][mA][mUs][mGs][mG] | 246 |
| 39 | [mUs][mC][mC][mU][mG][mC][mG][fA][fG][fC][fU][mC][mC][mU][mU][mG][mG][mU][mG][mA][mG][mC][mA][mG][mC][mC][mG][ademA-GalNAc][ademA-GalNAc][ademA-GalNAc][mG][mG][mC][mU][mG][mC] | 247 | [MePhosphonate-40-mUs][fAs][fCs][fC][fC][mA][fA][mG][mG][mA][mG][mC][mU][fC][mG][mC][mA][mG][mG][mAs][mGs][mG] | 248 |
| 40 | [mGs][mC][mU][mG][mC][mC][mC][fC][fU][fG][fU][mA][mG][mG][mU][mU][mG][mC][mU][mA][mG][mC][mA][mG][mC][mC][mG][ademA-GalNAc][ademA-GalNAc][ademA-GalNAc][mG][mG][mC][mU][mG][mC] | 249 | [MePhosphonate-40-mUs][fAs][fGs][fC][fA][mA][fC][mC][mU][fA][mC][mA][mG][mG][mG][mG][mC][mA][mG][mCs][mGs][mG] | 250 |
| 41 | [mGs][mU][mA][mG][mG][mU][mU][fG][fC][fU][fU][mA][mA][mA][mA][mG][mG][mG][mA][mA][mG][mC][mA][mG][mC][mC][mG][ademA-GalNAc][ademA-GalNAc][ademA-GalNAc][mG][mG][mC][mU][mG][mC] | 251 | [MePhosphonate-40-mUs][fUs][fCs][fC][fC][mC][fU][mU][mU][fA][mA][mG][mC][mA][mC][mC][mU][mA][mCs][mGs][mG] | 252 |
| 42 | [mUs][mA][mG][mG][mU][mU][mG][fC][fU][fU][fA][mA][mU][mA][mG][mG][mA][mC][mA][mG][mC][mA][mG][mC][mC][mG][ademA-GalNAc][ademA-GalNAc][ademA-GalNAc][mG][mG][mC][mU][mG][mC] | 253 | [MePhosphonate-40-mUs][fGs][fUs][fC][fC][mC][fU][mU][mU][fU][mA][mA][mG][fC][mA][mA][mC][mC][mU][mAs][mGs][mG] | 254 |
| 43 | [mUs][mU][mG][mC][mU][mU][mA][fA][fA][fA][fG][mG][mA][mC][mA][mG][mU][mA][mA][mG][mC][mA][mG][mC][mC][mG][ademA-GalNAc][ademA-GalNAc][ademA-GalNAc][mG][mG][mC][mU][mG][mC] | 255 | [MePhosphonate-40-mUs][fUs][fAs][fC][fU][mGU][mU][fU][mA][mA][mG][mC][mA][mAs][mGs][mG] | 256 |
| 44 | [mUs][mG][mC][mU][mU][mA][mA][fA][fA][fG][fG][mG][mA][mC][mA][mG][mU][mA][mA][mG][mC][mA][mG][mC][mC][mG][ademA-GalNAc][ademA-GalNAc][ademA-GalNAc][mG][mG][mC][mU][mG][mC] | 257 | [MePhosphonate-40-mUs][fAs][fUs][fA][fC][mU][fG][mU][mC][mC][mU][mU][fU][mU][mA][mA][mG][mC][mAs][mGs][mG] | 258 |
| 45 | [mGs][mC][mU][mU][mA][mA][mA][fA][fG][mG][mU][mA][mU][mU][mA][mU][mA][mG][mC][mC][mG][ademA-GalNAc][ademA-GalNAc][ademA-GalNAc][mG][mG][mC][mU][mG][mC] | 259 | [MePhosphonate-40-mUs][fAs][fAs][fU][fA][mC][fU][mG][mU][fC][mC][mC][mU][fU][mU][mU][mA][mA][mG][mCs][mGs][mG] | 260 |
| 46 | [mCs][mU][mU][mA][mA][mA][mA][fG][fG][fG][fA][mC][mA][mG][mU][mA] | 261 | [MePhosphonate-40-mUs][fGs][fAs][fA][fU][mA][fC][mU][mG][fU][mC] | 262 |

| GalXC-APOC3 | Sense Strand (passenger; 36-mer) | SEQ ID NO: | Antisense Strand (guide; 22-mer) | SEQ ID NO: |
|---|---|---|---|---|
|  | ][mU][mU][mC][mA][mG][mC][mA][mG][mC][mC][mG][ademA-GalNAc][ademA-GalNAc][ademA-GalNAc][mG][mG][mC][mU][mG][mC] | | ][mC][mC][fU][mU][mU][mU][mA][mA][mGs][mGs][mG] | |
| 47 | [mAs][mA][mA][mA][mG][mG][mG][fA][fC][fA][fG][mU][mA][mU][mU][mC][mU][mC][mA][mA][mC][mC][mA][mG][mC][mC][mG][ademA-GalNAc][ademA-GalNAc][ademA-GalNAc][mG][mG][mC][mU][mG][mC] | 263 | [MePhosphonate-40-mUs][fUs][fGs][fA][fG][mA][fA][mU][mA][fC][mU][mG][mU][fC][mC][mC][mU][mU][mU][mUs][mGs][mG] | 264 |
| 48 | [mGs][mG][mA][mC][mA][mG][mU][fA][fU][fU][fC][fU][mU][mC][mA][mG][mU][mG][mC][mU][mA][mG][mC][mA][mG][mC][mC][mG][ademA-GalNAc][ademA-GalNAc][ademA-GalNAc][mG][mG][mC][mU][mG][mC] | 265 | [MePhosphonate-40-mUs][fAs][fGs][fC][fA][mC][fU][mG][mA][fG][mA][mA][mU][fA][mC][mU][mG][mU][mC][mCs][mGs][mG] | 266 |
| 49 | [mGs][mA][mC][mA][mG][mU][mA][fU][fU][fC][fU][fU][mC][mA][mG][mU][mG][mC][mU][mA][mG][mC][mA][mG][mC][mC][mG][ademA-GalNAc][ademA-GalNAc][ademA-GalNAc][mG][mG][mC][mU][mG][mC] | 267 | [MePhosphonate-40-mUs][fGs][fAs][fG][fC][mA][fC][mU][mG][fA][mG][mA][mA][fU][mA][fC][mU][mG][mU][mCs][mGs][mG] | 268 |
| 50 | [mCs][mA][mG][mU][mA][mU][mU][fC][fU][fC][fA][fG][mU][mG][mC][mU][mU][mC][mU][mA][mG][mC][mA][mG][mC][mC][mG][ademA-GalNAc][ademA-GalNAc][ademA-GalNAc][mG][mG][mC][mU][mG][mC] | 269 | [MePhosphonate-40-mUs][fGs][fAs][fG][fA][mG][fC][mA][mC][fU][mG][mA][mG][fA][mA][mU][mA][mC][mU][mGs][mGs][mG] | 270 |
| 51 | [mUs][mA][mA][mA][mG][mC][mU][fG][fA][fC][mA][mG][mA][mA][mG][mC][mU][mA][mG][mC][mA][mG][mC][mC][mG][ademA-GalNAc][ademA-GalNAc][ademA-GalNAc][mG][mG][mC][mU][mG][mC] | 271 | [MePhosphonate-40-mUs][fAs][fGs][fC][fU][mU][fC][mU][mG][mU][mC][mC][fA][mG][mC][mU][mU][mU][mAs][mGs][mG] | 272 |
| 52 | [mAs][mA][mA][mG][mC][mU][mG][fG][fA][fC][fA][mA][mG][mA][mA][mG][mA][mG][mC][mU][mA][mG][mC][mA][mG][mC][mC][mG][ademA-GalNAc][ademA-GalNAc][ademA-GalNAc][mG][mG][mC][mU][mG][mC] | 273 | [MePhosphonate-40-mUs][fCs][fAs][fG][fC][mU][fU][mC][mU][fU][mG][mU][mC][fC][mA][mG][mC][mU][mU][mUs][mGs][mG] | 274 |
| 53 | [mCs][mU][fG][mU][fC][mC][mC][fU][fA][fA][fU][mA][fA][mA][fU][mC][fU][mG][mG][mC][mG][mC][mA][mG][mC][mC][mG][ademA-GalNAc][ademA-GalNAc][ademA-GalNAc][mG][mG][mC][mU][mG][mC] | 275 | [MePhosphonate-40-mUs][fCs][fCs][mA][fG][mC][fU][mU][mU][fA][mU][fU][mA][fG][mG][fG][fA][mC][fA][mGs][mGs][mG] | 276 |
| 54 | [mAs][mG][fC][mU][mU][mC][mA][fU][fG][fC][mA][fG][fG][mG][mU][mU][fA][mC][mA][mA][mG][mC][mA][mG][mC][mC][prgG-peg-GalNAc][prgA-peg-GalNAc][prgA-peg-GalNAc][mG][mG][mC][mU][mG][mC] | 277 | [Phosphonate-40-mUs][fUs][fGs][mU][fA][mU][mA][fU][mG][fA][mA][mG][fC][mUs][mGs][mG] | 278 |
| 55 | [mCs][mU][fG][mG][mA][mA][mG][fA][fC][fC][mG][fU][fU][mA][mA][mG][fG][mA][mC][mA][mG][mC][mC][prgG-peg-GalNAc][prgA-peg-GalNAc][prgApeg-GalNAc][prgA-peg-GalNAc][mG][mG][mC][mU][mG][mC] | 279 | [Phosphonate-40-mUs][fGs][fUs][mC][fC][mU][fU][fA][mA][fC][mG][fG][mU][fG][mC][fU][mC][mC][fA][mGs][mGs][mG] | 280 |
| 56 | [mGs][mC][fA][mC][mC][mG][mU][fU][fA][fA][mG][fG][fA][mC][fC][mU][fG][mU][mU][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 281 | [Phosphonate-40-mUs][fAs][fAs][mC][fU][mU][fG][fU][mC][fC][mU][fU][mA][fA][mC][fG][mG][mU][fG][mCs][mGs][mG] | 282 |
| 57 | [mUs][mG][fU][mA][mG][mG][mU][fU][fG][fC][mU][fU][fA][mA][mA][mA][fG][mG][mG][mA][mG][mC][mA][mG] | 283 | [Phosphonate-40-mUs][fCs][fCs][mC][fU][mC][mA][fA][mC][fC][mU][mA][fC][mAs][mGs][mG] | 284 |

-continued

| GalXC-APOC3 | Sense Strand (passenger; 36-mer) | SEQ ID NO: | Antisense Strand (guide; 22-mer) | SEQ ID NO: |
|---|---|---|---|---|
| | ][mC][mC][prgG-peg-GalNAc][prgA-peg-GalNAc][prgA-peg-GalNAc][prgA-peg-GalNAc][mG][mG][mC][mU][mG][mC] | | | |
| 58 | [mGs][mU][fU][mG][mC][mU][mU][fA][fA][fA][mA][fG][fG][mG][mA][mC][fA][mU][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 285 | [Phosphonate-40-mUs][fAs][fCs][mU][fG][mU][mU][fA][mA][fG][mC][mA][fA][mCs][mGs][mG] | 286 |
| 59 | [mGs][mA][fG][mC][fA][mC][mC][fG][fU][fU][fA][mA][fG][mG][mA][mC][fA][mA][mG][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 287 | [Phosphonate-40-mUs][fCs][fUs][mU][fG][mU][fC][mC][mU][fU][mA][fA][mC][fG][mG][fU][fG][mC][fU][mCs][mGs][mG] | 288 |
| 60 | [mAs][mG][fC][mA][fC][mC][mG][fU][fU][fA][fA][mG][fG][mA][fC][mA][fA][mG][mU][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 289 | [Phosphonate-40-mUs][fAs][fCs][mU][fU][mG][fU][mC][mC][fU][mU][fA][mA][fC][mG][fG][fU][mG][fC][mUs][mGs][mG] | 290 |
| 61 | [mCs][mU][fG][mU][fA][mG][mG][fU][fU][fG][fC][mU][fU][mA][fA][mA][fA][mG][mG][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 291 | [Phosphonate-40-mUs][fCs][fCs][mU][fU][mU][fU][mA][mA][fG][mC][fA][mA][mC][fC][fU][fA][mC][fA][mGs][mGs][mG] | 292 |
| 62 | [mAs][mG][fG][mU][fU][mG][mC][fU][fU][fA][fA][mA][fA][fG][fG][mA][mC][mA][mA][mG][mC][mA][mG][mC][mC][prgG-peg-GalNAc][prgA-peg-GalNAc] | 293 | [Phosphonate-40-mUs][fUs][fGs][mU][fC][mC][fU][mU][fU][mU][fA][mA][fG][mC][fA][fA][mC][fC][mUs][mGs][mG] | 294 |

-continued

| GalXC-APOC3 | Sense Strand (passenger; 36-mer) | SEQ ID NO: | Antisense Strand (guide; 22-mer) | SEQ ID NO: |
|---|---|---|---|---|
| | -[prgApeg-GalNAc][prgA-peg-GalNAc][mG][mG][mC][mU][mG][mC] | | | |
| 63 | [mGs][mG][fU][mU][fG][mC][mU][fU][fA][fA][fA][mA][fG][mG][fG][mA][fC][mA][mG][mA][mG][mC][mA][mG][mC][mC][prgG-peg-GalNAc][prgA-peg-GalNAc][prgA-peg-GalNAc][mG][mG][mC][mU][mG][mC] | 295 | [Phosphonate-40-mUs][fCs][fUs][mG][fU][mC][fC][mC][mU][fU][mU][fU][mA][fA][mG][fC][fA][mA][fC][mCs][mGs][mG] | 296 |
| 64 | [mCs][mC][fA][mA][fU][mA][mA][fA][fG][fC][fU][mG][fG][mA][fC][mA][fA][mG][mA][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 297 | [Phosphonate-40-mUs][fUs][fCs][mU][fU][mG][fU][mC][mC][fA][mG][fC][mU][fU][mU][fA][fU][mU][fG][mGs][mGs][mG] | 298 |
| 65 | [mAs][mU][fG][mG][fC][mU][mU][fC][fA][fG][fU][mU][fC][mC][fC][mU][fG][mA][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 299 | [Phosphonate-40-mUs][fUs][fUs][mC][fA][mG][fG][mG][mA][fA][mC][fU][mG][fA][mA][fG][fC][mC][fA][mUs][mGs][mG] | 300 |
| 66 | [mGs][mC][fU][mU][fC][mA][mG][fU][fU][fC][fC][mC][fU][mG][fA][mA][fA][mG][mA][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 301 | [Phosphonate-40-mUs][fUs][fCs][mU][fU][mU][fC][mA][mG][fG][mG][mA][fA][mC][fU][mG][fA][mA][fG][mCs][mGs][mG] | 302 |
| 67 | [mCs][mA][fG][mU][fU][mC][mC][fC][fU][fG][fA][mA][fA][mG][fA][mC][fU][mA][mC][mA][mG][mC][mC][prgG-peg-GalNAc][prgA-peg-GalNAc][prgA-peg-GalNAc][prgA-peg-GalNAc] | 303 | [Phosphonate-40-mUs][fGs][fUs][mA][fG][mU][fC][mU][mU][fU][mC][fA][mG][fG][mG][fA][mA][fC][fU][mGs][mGs][mG] | 304 |

| GalXC-APOC3 | Sense Strand (passenger; 36-mer) | SEQ ID NO: | Antisense Strand (guide; 22-mer) | SEQ ID NO: |
|---|---|---|---|---|
| 68 | [mAs][mG][fU][mU][fC][mC][mC][fU][fG][fA][fA][mA][fG][mA][fC][mU][fA][mC][mU][fA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 305 | [Phosphonate-40-mUs][fAs][fGs][mU][fA][mG][fU][mC][mU][fU][mU][fC][mA][fG][mG][fG][fA][mA][fC][mUs][mGs][mG] | 306 |
| 69 | [mCs][mC][fU][mG][fA][mA][mA][fG][fA][fC][fU][mA][fC][mU][fG][mG][fA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 307 | [Phosphonate-40-mUs][fGs][fCs][mU][fC][mC][fA][mG][mU][fA][mG][fU][mC][fU][mU][fU][mC][fA][fG][mGs][mGs][mG] | 308 |
| 70 | [mGs][mA][fA][mA][fG][mA][fC][fU][fA][fC][fU][mG][fG][mA][fG][mC][fA][mC][mC][mA][mG][mC][mC][mA][mG][mC][mC][prgG-peg-GalNAc][prgA-peg-GalNAc][prgA-peg-GalNAc][mG][mG][mC][mU][mG][mC] | 309 | [Phosphonate-40-mUs][fGs][fGs][mU][fG][mC][fU][mC][mC][fA][mG][fU][mA][fG][mU][fC][fU][mU][fU][mCs][mGs][mG] | 310 |
| 71 | [mGs][mA][fC][mU][fA][mC][mU][fG][fG][fA][fG][mC][fA][mC][fC][mG][fU][mU][mA][mA][mG][mC][mC][mA][mG][mC][prgG-peg-GalNAc][prgA-peg-GalNAc][prgA-peg-GalNAc][prgA-peg-GalNAc][mG][mG][mC][mU][mG][mC] | 311 | [Phosphonate-40-mUs][fUs][fAs][mA][fC][mG][fG][mU][mG][fC][mU][fC][mC][mA][fG][mU][fA][fG][mU][fCs][mGs][mG] | 312 |
| 72 | [mAs][mC][fU][mG][fG][mA][mG][fC][fA][fC][fC][mG][fU][mU][fA][mA][mG][mA][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 313 | [Phosphonate-40-mU][fA][mA][mC][fG][mG][fU][mG][fC][mU][fC][fC][mA][fG][mUs][mGs][mG] | 314 |
| 73 | [mGs][mG][fA][mG][fC][mA][mC][fC][fG][fU][mA][fC][mA][mA][mG][mG][mC][mA][mG][mC][mC][prgG-peg-GalNAc][prgA-peg-GalNAc][prgA-peg-GalNAc][mG][mG][mC][mU][mG][mC] | 315 | [Phosphonate-40-mUs][fUs][fUs][mG][fU][mC][fC][mU][mU][fA][mA][fC][mG][fG][mU][fG][fC][mU][fC][mCs][mGs][mG] | 316 |
| 74 | [mGs][mC][fU][mU][fC][mA][mU][fG][fC][fA][fG][mG][fG][mU][fU][mA][fC][mA][mU][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 317 | [Phosphonate-40-mUs][fAs][fUs][mG][fU][mA][fA][mC][mC][fC][mU][fG][mC][fA][mU][fG][fA][mA][fG][mCs][mGs][mG] | 318 |
| 75 | [mCs][mA][fC][mC][fG][mU][mU][fA][fA][fG][mA][fC][mA][fA][mG][fU][mU][mC][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 319 | [Phosphonate-40-mUs][fGs][fAs][mA][fC][mU][mU][fA][mA][fC][fG][mG][fU][mGs][mG] | 320 |
| 76 | [mAs][mC][fA][mA][fG][mU][mU][fC][fU][fC][mU][fC][mU][mG][mA][mG][mC][mA][mG][mC][mC][mC][prgG-peg-GalNAc][prgA-peg-GalNAc][prgA-peg-GalNAc][prgA-peg-GalNAc][mG][mG][mC][mU][mG][mC] | 321 | [Phosphonate-40-mUs][fCs][fAs][mG][fA][mA][fC][mU][fA][mG][fA][mA][fC][fU][mU][fG][mUs][mGs][mG] | 322 |
| 77 | [mAs][mA][fG][mU][mU][mC][mU][fC][fU][fG][mA][fG][fU][mU][mC][mU][fG][mG][mG][mA][mG][mC][mA][mG][mC][mC][prgG-peg-GalNAc][prgA-peg-GalNAc][prgA-peg-GalNAc][prgA-peg-GalNAc][mG][mG][mC][mU][mG][mC] | 323 | [Phosphonate-40-mUs][fCs][fCs][mC][fA][mG][fA][mA][fC][mU][fC][fA][mG][fA][mG][fA][mA][fC][mU][fU][mGs][mGs][mG] | 324 |
| 78 | [mAs][mG][fU][mU][mC][mU][mC][fU][fG][fA][mG][fU][fU][mC][mU][mG][fG][mG][mA][mA][mG][mC][mA][mG][mC][mC][mC] | 325 | [Phosphonate-40-mUs][fUs][fCs][mC][fC][mA][fG][mA][fA][mC][mU][fC][fA][mG][fA][mG][fA][mA][fC][mUs][mGs][mG] | 326 |

| SEQ ID NO: | Sense Strand GalXC- (passenger; APOC3 36-mer) | Antisense SEQ Strand ID (guide; NO: 22-mer) | SEQ ID NO: |
|---|---|---|---|
| | [prgG-peg-GalNAc] [prgA-peg-GalNAc] [prgA-peg-GalNAc] [prgA-peg-GalNAc] [mG][mG][mC] [mU][mG][mC] | | |
| 79 | [mGs][mU][fU][mC][mU][mC][mU][fG][fA][fG][mU][fU][fC][mU][mG][mG][fG][mA][mU][mA][mG][mC][mA][mG][mC][mC] [prgG-peg-GalNAc] [prgA-peg-GalNAc] [prgA-peg-GalNAc] [prgA-peg-GalNAc] [mG][mG][mC] [mU][mG] [mC] | 327 [Phosphonate-4O-mUs][fAs][fUs][mC][fC][mC][fA][fG][mA][fA][mC][fU][mC][fA][mG][fA][mG][mA][fA][mCs][mGs][mG] | 328 |
| 80 | [mGs][mG][fA][mC][mC][mC][mU][fG][fA][fG][mG][fU][fC][mA][mG][mA][fC][mC][mA][mA][mG][mC][mA][mG][mC][mC] [prgG-peg-GalNAc] [prgA-peg-GalNAc] [prgA-peg-GalNAc] [prgA-peg-GalNAc] [mG][mG][mC] [mU][mG][mC] | 329 [Phosphonate-4O-mUs][fUs][fGs][mG][fU][mC][fU][fG][mA][fC][mC][fU][mC][fA][mG][fG][mG][mU][fC][mCs][mGs][mG] | 330 |
| 81 | [mGs][mU][fA][mU][mU][mC][mU][fC][fA][fG][mU][fG][fC][mU][mC][mU][fC][mC][mU][mA][mG][mC][mA][mG][mC][mC] [prgG-peg-GalNAc] [prgA-peg-GalNAc] [prgA-peg-GalNAc] [prgA-peg-GalNAc] [mG][mG][mC] [mU][mG][mC] | 331 [Phosphonate-4O-mUs][fAs][fGs][mG][fA][mG][fA][fG][mC][fA][mC][fU][mG][fA][mG][fA][mA][mU][fA][mCs][mGs][mG] | 332 |

| | | SEQ ID NO: |
|---|---|---|
| Artificial Sequence | GCAGCCGAAAGGCUGC | 333 |
| Target Sequence 1 | TTCAGTTCCCTGAAAGACTA | 334 |
| Target Sequence 2 | TGGAGCACCGTTAAGGACAA | 335 |
| Target Sequence 3 | ACCGTTAAGGACAAGTTCT | 336 |
| Target Sequence 4 | GCTGCCCCTGTAGGTTGCT | 337 |
| Target Sequence 5 | GTAGGTTGCTTAAAAGGGA | 338 |
| Target Sequence 6 | CTTAAAAGGGACAGTATTC | 339 |
| Target Sequence 7 | AAAAGGGACAGTATTCTCA | 340 |
| Target Sequence 8 | GACAGTATTCTCAGTGCTC | 341 |

SEQUENCE LISTING (341 sequences)

SEQ ID NO: 1 - DNA, 535 bp, Homo sapiens
  misc_feature 1..535: note = Description of sequence: APOC3-NCBI Ref. Seq. No. NM_000040.3
  source 1..535: mol_type = genomic DNA
ctgctcagttcatccctagaggcagctgctccaggaacagaggtgccatgcagccccgggtactccttgttgttgccctcctggcgctcctggcctctgcccgagcttcagaggccgaggatgcctcccttctcagcttcatgcagggttacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgcgagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatga

SEQ ID NO: 2 - protein, 99 aa, Homo sapiens
  REGION 1..99: note = Description of sequence: APOC3- NCBI Ref. Seq. No. NP_079501.2
MQPRVLLVVALLALLASARASEAEDASLLSFMQGYMKHATKTAKDALSSVQESQVAQQARGWVTDGFSSLKDYWSTVKDKFSEFWDLDPEVRPTSAVAA

SEQ ID NO: 3 - DNA, 631 bp, Mus musculus
  misc_feature 1..631: note = Description of sequence: APOC3-NCBI Ref. Seq. No. NM_001289755.1
  source 1..631: mol_type = genomic DNA
gcctgctcagttttatccctagaagcagctagctactccaggtaatgcccctggggaggagaggaaggaagggaagaaacaaagagctggagggagaagctctcaccacccagccatctagcccacagaaggcttgggactcatggtacgtaggtgccatgcagccccggacgctcctcactgtggccctcttggctctcctggcatctgcccgagctgaagaggtagagggatccttgctgctgggctctgtacagggctacatggaacaagcctccaagacggtccaggatgcgctaagtagcgtgcaggagtccgatatagctgtggtggccaggggctggatggacaatcacttcagatccctgaaaggctactggagcaagtttactgacaagttcaccggcttctgggattctaaccctgaggaccaaccaactccagctattgagtcgtgagacttctgtgttgcagatgtgcctgttcctccatcctgctgcccccctccaggcctgccaggtggcccctgaaggttgctttaaggggaaagtatgttctcatgtcttcacccctccctagatctcacctaaacatgctgtccctaataaagctggataagaagctgctgtta

SEQ ID NO: 4 - protein, 99 aa, Mus musculus
  REGION 1..99: note = Description of sequence: APOC3- NCBI Ref. Seq. No. NP_001276684.1
MQPRTLLTVALLALLASARAEEVEGSLLLGSVQGYMEQASKTVQDALSSVQESDIAVVARGWMDNHFRSLKGYWSKFTDKFTGFWDSNPEDQPTPAIES

SEQ ID NO: 5 - DNA, 579 bp, Rattus norvegicus
  misc_feature 1..579: note = Description of sequence: APOC3-NCBI Ref. Seq. No. NM_001271053
  source 1..579: mol_type = genomic DNA
atgcccctggggaggagaggaagggagggaggagacagagagaagacgctctggccactcagccagctagcctacagaatgcttggaattcatggcctccacccttgggttcctggtgcacaggtgccatgcagccccgaatgctcctcatcgtggccctcgtggctctcctggcctctgcccgagctgatgagggagagggatccttgctgctgggctctatgcagggctacatggaacaagcctccaagacggtccaggatgcactaagcagcatgcaggagtctgatatagctgtggtggccaggggctggatggacaatcgcttcaaatccctgaaaggctactggagcaagttcactgataagttcactggcctctgggagtctggccctgaggaccaactaacaacaccaactcttgagccgtgagacctccatgttccagatgtgtctggccatctatcctgctgcctccgaaggttgctctaaggggaaagtatattctcatgcctttatccctccccagacctcacctaaacatgctgtccctaataaagctggacacgaagctgccatg

SEQ ID NO: 6 - protein, 100 aa, Rattus norvegicus
  REGION 1..100: note = Description of sequence: APOC3- NCBI Ref. Seq. No. NP_001257982.1
MQPRMLLIVALVALLASARADEGEGSLLLGSMQGYMEQASKTVQDALSSMQESDIAVVARGWMDNRFKSLKGYWSKFTDKFTGLWESGPEDQLTTPTLEP

SEQ ID NO: 7 - DNA, 567 bp, Macaca fascicularis
  misc_feature 1..567: note = Description of sequence: APOC3-NCBI Ref. Seq. No. XM_005579730.1
  source 1..567: mol_type = genomic DNA
aatataaaacaggtcagaaccctcctgcctgcctgctctgttcatccctagaggcagctgctccaggaacagaggcgccatgcagccccgggtactccttgttgctgccctgctgtcactcctggcctctgccagagcttcagaggccgaggacacctcccttcttggcttcatgcagggctacatgcagcatgccaccaagaccgccaaggatgcactgaccagcgtccaggagtcccaggtggcccagcaggccagaggctgggtgaccgatggcttcagttccctgaaagactactggagcaccgttaaggacaagttatctgggttctgggatttgaaccctgaggccaaacccactctggctgaggctgcctgagacctcaataccccaagtccacctgcctgtccatcctgccagctccttgggtcctgcagcctccagggctgcccctgtaggttgcttaaaagggacagtattctcagtgccctcctaccgcacctcatgcctggcccccctccaggcagggtgtcctcccaataaagctggacaagaagctgctatga

SEQ ID NO: 8 - protein, 99 aa, Macaca fascicularis
  REGION 1..99: note = Description of sequence: APOC3- NCBI Ref. Seq. No. XP_005579787.1
MQPRVLLVAALLSLLASARASEAEDTSLLGFMQGYMQHATKTAKDALTSVQESQVAQQARGWVTDGFSSLKDYWSTVKDKLSGFWDLNPEAKPTLAEAA

SEQ ID NO: 9 - RNA, 36 nt, synthetic construct
  misc_feature 1..36: note = Description of sequence: GalXC-APOC3-1-Sense
  source 1..36: mol_type = other RNA
ctagaggcagctgctccagagcagccgaaaggctgc

SEQ ID NO: 10 - RNA, 22 nt, synthetic construct
  misc_feature 1..22: note = Description of sequence: GalXC-APOC3-1-Antisense
  source 1..22: mol_type = other RNA
tctggagcagctgcctctaggg

SEQ ID NO: 11 - RNA, 36 nt, synthetic construct
  misc_feature 1..36: note = Description of sequence: GalXC-APOC3-2-Sense
  source 1..36: mol_type = other RNA
ggtactccttgttgttgccagcagccgaaaggctgc

SEQ ID NO: 12 - RNA, 22 nt, synthetic construct
  misc_feature 1..22: note = Description of sequence: GalXC-APOC3-2-Antisense
  source 1..22: mol_type = other RNA
tggcaacaacaaggagtaccgg

SEQ ID NO: 13 - RNA, 36 nt, synthetic construct
  misc_feature 1..36: note = Description of sequence: GalXC-APOC3-3-Sense
  source 1..36: mol_type = other RNA
gaggccgaggatgcctcccagcagccgaaaggctgc

SEQ ID NO: 14 - RNA, 22 nt, synthetic construct
  misc_feature 1..22: note = Description of sequence: GalXC-APOC3-3-Antisense
  source 1..22: mol_type = other RNA
tgggaggcatcctcggcctcgg

SEQ ID NO: 15 - RNA, 36 nt, synthetic construct
  misc_feature 1..36: note = Description of sequence: GalXC-APOC3-4-Sense
  source 1..36: mol_type = other RNA
ccttctcagcttcatgcagagcagccgaaaggctgc

SEQ ID NO: 16 - RNA, 22 nt, synthetic construct
  misc_feature 1..22: note = Description of sequence: GalXC-APOC3-4-Antisense
  source 1..22: mol_type = other RNA
tctgcatgaagctgagaagggg

SEQ ID NO: 17 - RNA, 36 nt, synthetic construct
  misc_feature 1..36: note = Description of sequence: GalXC-APOC3-5-Sense
  source 1..36: mol_type = other RNA
cttctcagcttcatgcaggagcagccgaaaggctgc

SEQ ID NO: 18 - RNA, 22 nt, synthetic construct
  misc_feature 1..22: note = Description of sequence: GalXC-APOC3-5-Antisense
  source 1..22: mol_type = other RNA
tcctgcatgaagctgagaaggg

SEQ ID NO: 19 - RNA, 36 nt, synthetic construct
  misc_feature 1..36: note = Description of sequence: GalXC-APOC3-6-Sense
  source 1..36: mol_type = other RNA
ctcagcttcatgcagggttagcagccgaaaggctgc

SEQ ID NO: 20 - RNA, 22 nt, synthetic construct
  misc_feature 1..22: note = Description of sequence: GalXC-APOC3-6-Antisense
  source 1..22: mol_type = other RNA
taaccctgcatgaagctgaggg

SEQ ID NO: 21 - RNA, 36 nt, synthetic construct
  misc_feature 1..36: note = Description of sequence: GalXC-APOC3-7-Sense
  source 1..36: mol_type = other RNA
atgcactgagcagcgtgcaagcagccgaaaggctgc

SEQ ID NO: 22 - RNA, 22 nt, synthetic construct
  misc_feature 1..22: note = Description of sequence: GalXC-APOC3-7-Antisense
  source 1..22: mol_type = other RNA
ttgcacgctgctcagtgcatgg

SEQ ID NO: 23 - RNA, 36 nt, synthetic construct
  misc_feature 1..36: note = Description of sequence: GalXC-APOC3-8-Sense
  source 1..36: mol_type = other RNA
tgcactgagcagcgtgcagagcagccgaaaggctgc

SEQ ID NO: 24 - RNA, 22 nt, synthetic construct
  misc_feature 1..22: note = Description of sequence: GalXC-APOC3-8-Antisense
  source 1..22: mol_type = other RNA
tctgcacgctgctcagtgcagg

SEQ ID NO: 25 - RNA, 36 nt, synthetic construct
  misc_feature 1..36: note = Description of sequence: GalXC-APOC3-9-Sense
  source 1..36: mol_type = other RNA
ctgagcagcgtgcaggagtagcagccgaaaggctgc

SEQ ID NO: 26 - RNA, 22 nt, synthetic construct
  misc_feature 1..22: note = Description of sequence: GalXC-APOC3-9-Antisense
  source 1..22: mol_type = other RNA
tactcctgcacgctgctcaggg

SEQ ID NO: 27 - RNA, 36 nt, synthetic construct
  misc_feature 1..36: note = Description of sequence: GalXC-APOC3-10-Sense
  source 1..36: mol_type = other RNA
agcagcgtgcaggagtcccagcagccgaaaggctgc

SEQ ID NO: 28 - RNA, 22 nt, synthetic construct
  misc_feature 1..22: note = Description of sequence: GalXC-APOC3-10-Antisense
  source 1..22: mol_type = other RNA
tgggactcctgcacgctgctgg

SEQ ID NO: 29 - RNA, 36 nt, synthetic construct
  misc_feature 1..36: note = Description of sequence: GalXC-APOC3-11-Sense
  source 1..36: mol_type = other RNA
tgcaggagtcccaggtggcagcagccgaaaggctgc

SEQ ID NO: 30 - RNA, 22 nt, synthetic construct
  misc_feature 1..22: note = Description of sequence: GalXC-APOC3-11-Antisense
  source 1..22: mol_type = other RNA
tgccacctgggactcctgcagg

SEQ ID NO: 31 - RNA, 36 nt, synthetic construct
  misc_feature 1..36: note = Description of sequence: GalXC-APOC3-12-Sense
  source 1..36: mol_type = other RNA
ggggctgggtgaccgatggagcagccgaaaggctgc

SEQ ID NO: 32 - RNA, 22 nt, synthetic construct
  misc_feature 1..22: note = Description of sequence: GalXC-APOC3-12-Antisense
  source 1..22: mol_type = other RNA
tccatcggtcacccagccccgg

SEQ ID NO: 33 - RNA, 36 nt, synthetic construct
  misc_feature 1..36: note = Description of sequence: GalXC-APOC3-13-Sense
  source 1..36: mol_type = other RNA
ggcttcagttccctgaaagagcagccgaaaggctgc

SEQ ID NO: 34 - RNA, 22 nt, synthetic construct
  misc_feature 1..22: note = Description of sequence: GalXC-APOC3-13-Antisense
  source 1..22: mol_type = other RNA
tctttcagggaactgaagccgg

SEQ ID NO: 35 - RNA, 36 nt, synthetic construct
  misc_feature 1..36: note = Description of sequence: GalXC-APOC3-14-Sense
  source 1..36: mol_type = other RNA
cttcagttccctgaaagacagcagccgaaaggctgc

SEQ ID NO: 36 - RNA, 22 nt, synthetic construct
  misc_feature 1..22: note = Description of sequence: GalXC-APOC3-14-Antisense
  source 1..22: mol_type = other RNA
tgtctttcagggaactgaaggg

SEQ ID NO: 37 - RNA, 36 nt, synthetic construct
  misc_feature 1..36: note = Description of sequence: GalXC-APOC3-15-Sense
  source 1..36: mol_type = other RNA
ttcagttccctgaaagactagcagccgaaaggctgc

SEQ ID NO: 38 - RNA, 22 nt, synthetic construct
  misc_feature 1..22: note = Description of sequence: GalXC-APOC3-15-Antisense
  source 1..22: mol_type = other RNA
tagtctttcagggaactgaagg

SEQ ID NO: 39 - RNA, 36 nt, synthetic construct
  misc_feature 1..36: note = Description of sequence: GalXC-APOC3-16-Sense
  source 1..36: mol_type = other RNA
agactactggagcaccgttagcagccgaaaggctgc

SEQ ID NO: 40 - RNA, 22 nt, synthetic construct
  misc_feature 1..22: note = Description of sequence: GalXC-APOC3-16-Antisense
  source 1..22: mol_type = other RNA
taacggtgctccagtagtctgg

SEQ ID NO: 41 - RNA, 36 nt, synthetic construct
  misc_feature 1..36: note = Description of sequence: GalXC-APOC3-17-Sense
  source 1..36: mol_type = other RNA
tactggagcaccgttaaggagcagccgaaaggctgc

SEQ ID NO: 42 - RNA, 22 nt, synthetic construct
  misc_feature 1..22: note = Description of sequence: GalXC-APOC3-17-Antisense
  source 1..22: mol_type = other RNA
tccttaacggtgctccagtagg

SEQ ID NO: 43 - RNA, 36 nt, synthetic construct
  misc_feature 1..36: note = Description of sequence: GalXC-APOC3-18-Sense
  source 1..36: mol_type = other RNA
tggagcaccgttaaggacaagcagccgaaaggctgc

SEQ ID NO: 44 - RNA, 22 nt, synthetic construct
  misc_feature 1..22: note = Description of sequence: GalXC-APOC3-18-Antisense
  source 1..22: mol_type = other RNA
ttgtccttaacggtgctccagg

SEQ ID NO: 45 - RNA, 36 nt, synthetic construct
  misc_feature 1..36: note = Description of sequence: GalXC-APOC3-19-Sense
  source 1..36: mol_type = other RNA
accgttaaggacaagttctagcagccgaaaggctgc

SEQ ID NO: 46 - RNA, 22 nt, synthetic construct
  misc_feature 1..22: note = Description of sequence: GalXC-APOC3-19-Antisense
  source 1..22: mol_type = other RNA
tagaacttgtccttaacggtgg

SEQ ID NO: 47 - RNA, 36 nt, synthetic construct
  misc_feature 1..36: note = Description of sequence: GalXC-APOC3-20-Sense
  source 1..36: mol_type = other RNA
ccgttaaggacaagttctcagcagccgaaaggctgc

SEQ ID NO: 48 - RNA, 22 nt, synthetic construct
  misc_feature 1..22: note = Description of sequence: GalXC-APOC3-20-Antisense
  source 1..22: mol_type = other RNA
tgagaacttgtccttaacgggg

SEQ ID NO: 49 - RNA, 36 nt, synthetic construct
  misc_feature 1..36: note = Description of sequence: GalXC-APOC3-21-Sense
  source 1..36: mol_type = other RNA
cgttaaggacaagttctctagcagccgaaaggctgc

SEQ ID NO: 50 - RNA, 22 nt, synthetic construct
  misc_feature 1..22: note = Description of sequence: GalXC-APOC3-21-Antisense
  source 1..22: mol_type = other RNA
tagagaacttgtccttaacggg

SEQ ID NO: 51 - RNA, 36 nt, synthetic construct
  misc_feature 1..36: note = Description of sequence: GalXC-APOC3-22-Sense
  source 1..36: mol_type = other RNA
gttaaggacaagttctctgagcagccgaaaggctgc

SEQ ID NO: 52 - RNA, 22 nt, synthetic construct
  misc_feature 1..22: note = Description of sequence: GalXC-APOC3-22-Antisense
  source 1..22: mol_type = other RNA
tcagagaacttgtccttaacgg

SEQ ID NO: 53 - RNA, 36 nt, synthetic construct
  misc_feature 1..36: note = Description of sequence: GalXC-APOC3-23-Sense
  source 1..36: mol_type = other RNA
aggacaagttctctgagttagcagccgaaaggctgc

SEQ ID NO: 54 - RNA, 22 nt, synthetic construct
  misc_feature 1..22: note = Description of sequence: GalXC-APOC3-23-Antisense
  source 1..22: mol_type = other RNA
taactcagagaacttgtcctgg

SEQ ID NO: 55 - RNA, 36 nt, synthetic construct; identical to SEQ ID NO: 53
  misc_feature 1..36: note = Description of sequence: GalXC-APOC3-24-Sense
  source 1..36: mol_type = other RNA

SEQ ID NO: 56 - RNA, 22 nt, synthetic construct
  misc_feature 1..22: note = Description of sequence: GalXC-APOC3-24-Antisense
  source 1..22: mol_type = other RNA
taactcagagaacttgtcctgg

SEQ ID NO: 57 - RNA, 36 nt, synthetic construct
  misc_feature 1..36: note = Description of sequence: GalXC-APOC3-25-Sense
  source 1..36: mol_type = other RNA
tgcctgagacctcaataccagcagccgaaaggctgc

SEQ ID NO: 58 - RNA, 22 nt, synthetic construct
  misc_feature 1..22: note = Description of sequence: GalXC-APOC3-25-Antisense
  source 1..22: mol_type = other RNA
tggtattgaggtctcaggcagg

SEQ ID NO: 59 - RNA, 36 nt, synthetic construct
  misc_feature 1..36: note = Description of sequence: GalXC-APOC3-26-Sense
  source 1..36: mol_type = other RNA
ccccaagtccacctgcctaagcagccgaaaggctgc

SEQ ID NO: 60 - RNA, 22 nt, synthetic construct
  misc_feature 1..22: note = Description of sequence: GalXC-APOC3-26-Antisense
  source 1..22: mol_type = other RNA
ttaggcaggtggacttgggggg

SEQ ID NO: 61 - RNA, 36 nt, synthetic construct
  misc_feature 1..36: note = Description of sequence: GalXC-APOC3-27-Sense
  source 1..36: mol_type = other RNA
cccaagtccacctgcctatagcagccgaaaggctgc

SEQ ID NO: 62 - RNA, 22 nt, synthetic construct
  misc_feature 1..22: note = Description of sequence: GalXC-APOC3-27-Antisense
  source 1..22: mol_type = other RNA
tataggcaggtggacttggggg

SEQ ID NO: 63 - RNA, 36 nt, synthetic construct
  misc_feature 1..36: note = Description of sequence: GalXC-APOC3-28-Sense
  source 1..36: mol_type = other RNA
caagtccacctgcctatccagcagccgaaaggctgc

SEQ ID NO: 64 - RNA, 22 nt, synthetic construct
  misc_feature 1..22: note = Description of sequence: GalXC-APOC3-28-Antisense
  source 1..22: mol_type = other RNA
tggataggcaggtggacttggg

SEQ ID NO: 65 - RNA, 36 nt, synthetic construct
  misc_feature 1..36: note = Description of sequence: GalXC-APOC3-29-Sense
  source 1..36: mol_type = other RNA
aagtccacctgcctatccaagcagccgaaaggctgc

SEQ ID NO: 66 - RNA, 22 nt, synthetic construct
  misc_feature 1..22: note = Description of sequence: GalXC-APOC3-29-Antisense
  source 1..22: mol_type = other RNA
ttggataggcaggtggacttgg

SEQ ID NO: 67 - RNA, 36 nt, synthetic construct
  misc_feature 1..36: note = Description of sequence: GalXC-APOC3-30-Sense
  source 1..36: mol_type = other RNA
agtccacctgcctatccatagcagccgaaaggctgc

SEQ ID NO: 68 - RNA, 22 nt, synthetic construct
  misc_feature 1..22: note = Description of sequence: GalXC-APOC3-30-Antisense
  source 1..22: mol_type = other RNA
tatggataggcaggtggactgg

SEQ ID NO: 69 - RNA, 36 nt, synthetic construct
  misc_feature 1..36: note = Description of sequence: GalXC-APOC3-31-Sense
  source 1..36: mol_type = other RNA
gtccacctgcctatccatcagcagccgaaaggctgc

SEQ ID NO: 70 - RNA, 22 nt, synthetic construct
  misc_feature 1..22: note = Description of sequence: GalXC-APOC3-31-Antisense
  source 1..22: mol_type = other RNA
tgatggataggcaggtggacgg

SEQ ID NO: 71 - RNA, 36 nt, synthetic construct
  misc_feature 1..36: note = Description of sequence: GalXC-APOC3-32-Sense
  source 1..36: mol_type = other RNA
tccacctgcctatccatccagcagccgaaaggctgc

SEQ ID NO: 72 - RNA, 22 nt, synthetic construct
  misc_feature 1..22: note = Description of sequence: GalXC-APOC3-32-Antisense
  source 1..22: mol_type = other RNA
tggatggataggcaggtggagg

SEQ ID NO: 73 - RNA, 36 nt, synthetic construct
  misc_feature 1..36: note = Description of sequence: GalXC-APOC3-33-Sense
  source 1..36: mol_type = other RNA
ccacctgcctatccatcctagcagccgaaaggctgc

SEQ ID NO: 74 - RNA, 22 nt, synthetic construct
  misc_feature 1..22: note = Description of sequence: GalXC-APOC3-33-Antisense
  source 1..22: mol_type = other RNA
taggatggataggcaggtgggg

SEQ ID NO: 75 - RNA, 36 nt, synthetic construct
  misc_feature 1..36: note = Description of sequence: GalXC-APOC3-34-Sense
  source 1..36: mol_type = other RNA
cacctgcctatccatcctgagcagccgaaaggctgc

SEQ ID NO: 76 - RNA, 22 nt, synthetic construct
  misc_feature 1..22: note = Description of sequence: GalXC-APOC3-34-Antisense
  source 1..22: mol_type = other RNA
tcaggatggataggcaggtggg

SEQ ID NO: 77 - RNA, 36 nt, synthetic construct
  misc_feature 1..36: note = Description of sequence: GalXC-APOC3-35-Sense
  source 1..36: mol_type = other RNA
cctgcctatccatcctgcgagcagccgaaaggctgc

SEQ ID NO: 78 - RNA, 22 nt, synthetic construct
  misc_feature 1..22: note = Description of sequence: GalXC-APOC3-35-Antisense
  source 1..22: mol_type = other RNA
tcgcaggatggataggcagggg

SEQ ID NO: 79 - RNA, 36 nt, synthetic construct
  misc_feature 1..36: note = Description of sequence: GalXC-APOC3-36-Sense
  source 1..36: mol_type = other RNA
tccatcctgcgagctccttagcagccgaaaggctgc

SEQ ID NO: 80 - RNA, 22 nt, synthetic construct
  misc_feature 1..22: note = Description of sequence: GalXC-APOC3-36-Antisense
  source 1..22: mol_type = other RNA
taaggagctcgcaggatggagg

SEQ ID NO: 81 - RNA, 36 nt, synthetic construct
  misc_feature 1..36: note = Description of sequence: GalXC-APOC3-37-Sense
  source 1..36: mol_type = other RNA
catcctgcgagctccttggagcagccgaaaggctgc

SEQ ID NO: 82 - RNA, 22 nt, synthetic construct
  misc_feature 1..22: note = Description of sequence: GalXC-APOC3-37-Antisense
  source 1..22: mol_type = other RNA
tccaaggagctcgcaggatggg

SEQ ID NO: 83 - RNA, 36 nt, synthetic construct
  misc_feature 1..36: note = Description of sequence: GalXC-APOC3-38-Sense
  source 1..36: mol_type = other RNA
atcctgcgagctccttgggagcagccgaaaggctgc

SEQ ID NO: 84 - RNA, 22 nt, synthetic construct
  misc_feature 1..22: note = Description of sequence: GalXC-APOC3-38-Antisense
  source 1..22: mol_type = other RNA
tcccaaggagctcgcaggatgg

SEQ ID NO: 85 - RNA, 36 nt, synthetic construct
  misc_feature 1..36: note = Description of sequence: GalXC-APOC3-39-Sense
  source 1..36: mol_type = other RNA
tcctgcgagctccttgggtagcagccgaaaggctgc

SEQ ID NO: 86 - RNA, 22 nt, synthetic construct
  misc_feature 1..22: note = Description of sequence: GalXC-APOC3-39-Antisense
  source 1..22: mol_type = other RNA
tacccaaggagctcgcaggagg

SEQ ID NO: 87 - RNA, 36 nt, synthetic construct
  misc_feature 1..36: note = Description of sequence: GalXC-APOC3-40-Sense
  source 1..36: mol_type = other RNA
gctgcccctgtaggttgctagcagccgaaaggctgc

SEQ ID NO: 88 - RNA, 22 nt, synthetic construct
  misc_feature 1..22: note = Description of sequence: GalXC-APOC3-40-Antisense
  source 1..22: mol_type = other RNA
tagcaacctacaggggcagcgg

SEQ ID NO: 89 - RNA, 36 nt, synthetic construct
  misc_feature 1..36: note = Description of sequence: GalXC-APOC3-41-Sense
  source 1..36: mol_type = other RNA
gtaggttgcttaaaagggaagcagccgaaaggctgc

SEQ ID NO: 90 - RNA, 22 nt, synthetic construct
  misc_feature 1..22: note = Description of sequence: GalXC-APOC3-41-Antisense
  source 1..22: mol_type = other RNA
ttcccttttaagcaacctacgg

SEQ ID NO: 91 - RNA, 36 nt, synthetic construct
  misc_feature 1..36: note = Description of sequence: GalXC-APOC3-42-Sense
  source 1..36: mol_type = other RNA
taggttgcttaaaagggacagcagccgaaaggctgc

SEQ ID NO: 92 - RNA, 22 nt, synthetic construct
  misc_feature 1..22: note = Description of sequence: GalXC-APOC3-42-Antisense
  source 1..22: mol_type = other RNA
tgtcccttttaagcaacctagg

SEQ ID NO: 93 - RNA, 36 nt, synthetic construct
  misc_feature 1..36: note = Description of sequence: GalXC-APOC3-43-Sense
  source 1..36: mol_type = other RNA
ttgcttaaaagggacagtaagcagccgaaaggctgc

SEQ ID NO: 94 - RNA, 22 nt, synthetic construct
  misc_feature 1..22: note = Description of sequence: GalXC-APOC3-43-Antisense
  source 1..22: mol_type = other RNA
ttactgtcccttttaagcaagg

SEQ ID NO: 95 - RNA, 36 nt, synthetic construct
  misc_feature 1..36: note = Description of sequence: GalXC-APOC3-44-Sense
  source 1..36: mol_type = other RNA
tgcttaaaagggacagtatagcagccgaaaggctgc

SEQ ID NO: 96 - RNA, 22 nt, synthetic construct
  misc_feature 1..22: note = Description of sequence: GalXC-APOC3-44-Antisense
  source 1..22: mol_type = other RNA
tatactgtcccttttaagcagg

SEQ ID NO: 97 - RNA, 36 nt, synthetic construct
  misc_feature 1..36: note = Description of sequence: GalXC-APOC3-45-Sense
  source 1..36: mol_type = other RNA
gcttaaaagggacagtattagcagccgaaaggctgc

SEQ ID NO: 98 - RNA, 22 nt, synthetic construct
  misc_feature 1..22: note = Description of sequence: GalXC-APOC3-45-Antisense
  source 1..22: mol_type = other RNA
taatactgtcccttttaagcgg

SEQ ID NO: 99 - RNA, 36 nt, synthetic construct
  misc_feature 1..36: note = Description of sequence: GalXC-APOC3-46-Sense
  source 1..36: mol_type = other RNA
cttaaaagggacagtattcagcagccgaaaggctgc

SEQ ID NO: 100 - RNA, 22 nt, synthetic construct
  misc_feature 1..22: note = Description of sequence: GalXC-APOC3-46-Antisense
  source 1..22: mol_type = other RNA
tgaatactgtcccttttaaggg

SEQ ID NO: 101 - RNA, 36 nt, synthetic construct
  misc_feature 1..36: note = Description of sequence: GalXC-APOC3-47-Sense
  source 1..36: mol_type = other RNA
aaaagggacagtattctcaagcagccgaaaggctgc

SEQ ID NO: 102 - RNA, 22 nt, synthetic construct
  misc_feature 1..22: note = Description of sequence: GalXC-APOC3-47-Antisense
  source 1..22: mol_type = other RNA
ttgagaatactgtcccttttgg

SEQ ID NO: 103 - RNA, 36 nt, synthetic construct
  misc_feature 1..36: note = Description of sequence: GalXC-APOC3-48-Sense
  source 1..36: mol_type = other RNA
ggacagtattctcagtgctagcagccgaaaggctgc

SEQ ID NO: 104 - RNA, 22 nt, synthetic construct
  misc_feature 1..22: note = Description of sequence: GalXC-APOC3-48-Antisense
  source 1..22: mol_type = other RNA
tagcactgagaatactgtccgg

SEQ ID NO: 105 - RNA, 36 nt, synthetic construct
  misc_feature 1..36: note = Description of sequence: GalXC-APOC3-49-Sense
  source 1..36: mol_type = other RNA
gacagtattctcagtgctcagcagccgaaaggctgc

SEQ ID NO: 106 - RNA, 22 nt, synthetic construct
  misc_feature 1..22: note = Description of sequence: GalXC-APOC3-49-Antisense
  source 1..22: mol_type = other RNA
tgagcactgagaatactgtcgg

SEQ ID NO: 107 - RNA, 36 nt, synthetic construct
  misc_feature 1..36: note = Description of sequence: GalXC-APOC3-50-Sense
  source 1..36: mol_type = other RNA
cagtattctcagtgctctcagcagccgaaaggctgc

SEQ ID NO: 108 - RNA, 22 nt, synthetic construct
  misc_feature 1..22: note = Description of sequence: GalXC-APOC3-50-Antisense
  source 1..22: mol_type = other RNA
tgagagcactgagaatactggg

SEQ ID NO: 109 - RNA, 36 nt, synthetic construct
  misc_feature 1..36: note = Description of sequence: GalXC-APOC3-51-Sense
  source 1..36: mol_type = other RNA
taaagctggacaagaagctagcagccgaaaggctgc

SEQ ID NO: 110 - RNA, 22 nt, synthetic construct
  misc_feature 1..22: note = Description of sequence: GalXC-APOC3-51-Antisense
  source 1..22: mol_type = other RNA
tagcttcttgtccagctttagg

SEQ ID NO: 111 - RNA, 36 nt, synthetic construct
  misc_feature 1..36: note = Description of sequence: GalXC-APOC3-52-Sense
  source 1..36: mol_type = other RNA
aaagctggacaagaagctgagcagccgaaaggctgc

SEQ ID NO: 112 - RNA, 22 nt, synthetic construct
  misc_feature 1..22: note = Description of sequence: GalXC-APOC3-52-Antisense
  source 1..22: mol_type = other RNA
tcagcttcttgtccagctttgg

SEQ ID NO: 113 - RNA, 36 nt, synthetic construct
  misc_feature 1..36: note = Description of sequence: GalXC-APOC3-53-Sense
  source 1..36: mol_type = other RNA
ctgtccctaataaagctggagcagccgaaaggctgc

SEQ ID NO: 114 - RNA, 22 nt, synthetic construct
  misc_feature 1..22: note = Description of sequence: GalXC-APOC3-53-Antisense
  source 1..22: mol_type = other RNA
tccagctttattagggacaggg

SEQ ID NO: 115 - RNA, 36 nt, synthetic construct
  misc_feature 1..36: note = Description of sequence: GalXC-APOC3-54-Sense
  source 1..36: mol_type = other RNA
agcttcatgcagggttacaagcagccgaaaggctgc

SEQ ID NO: 116 - RNA, 22 nt, synthetic construct
  misc_feature 1..22: note = Description of sequence: GalXC-APOC3-54-Antisense
  source 1..22: mol_type = other RNA
ttgtaaccctgcatgaagctgg

SEQ ID NO: 117 - RNA, 36 nt, synthetic construct
  misc_feature 1..36: note = Description of sequence: GalXC-APOC3-55-Sense
  source 1..36: mol_type = other RNA
ctggagcaccgttaaggacagcagccgaaaggctgc

SEQ ID NO: 118 - RNA, 22 nt, synthetic construct
  misc_feature 1..22: note = Description of sequence: GalXC-APOC3-55-Antisense
  source 1..22: mol_type = other RNA
tgtccttaacggtgctccaggg

SEQ ID NO: 119 - RNA, 36 nt, synthetic construct
  misc_feature 1..36: note = Description of sequence: GalXC-APOC3-56-Sense
  source 1..36: mol_type = other RNA
gcaccgttaaggacaagttagcagccgaaaggctgc

SEQ ID NO: 120 - RNA, 22 nt, synthetic construct
  misc_feature 1..22: note = Description of sequence: GalXC-APOC3-56-Antisense
  source 1..22: mol_type = other RNA
taacttgtccttaacggtgcgg

SEQ ID NO: 121 - RNA, 36 nt, synthetic construct
  misc_feature 1..36: note = Description of sequence: GalXC-APOC3-57-Sense
  source 1..36: mol_type = other RNA
tgtaggttgcttaaaagggagcagccgaaaggctgc

SEQ ID NO: 122 - RNA, 22 nt, synthetic construct
  misc_feature 1..22: note = Description of sequence: GalXC-APOC3-57-Antisense
  source 1..22: mol_type = other RNA
tcccttttaagcaacctacagg

SEQ ID NO: 123 - RNA, 36 nt, synthetic construct
  misc_feature 1..36: note = Description of sequence: GalXC-APOC3-58-Sense
  source 1..36: mol_type = other RNA
gttgcttaaaagggacagtagcagccgaaaggctgc

SEQ ID NO: 124 - RNA, 22 nt, synthetic construct
  misc_feature 1..22: note = Description of sequence: GalXC-APOC3-58-Antisense
  source 1..22: mol_type = other RNA
tactgtcccttttaagcaacgg

SEQ ID NO: 125 - RNA, 36 nt, synthetic construct
  misc_feature 1..36: note = Description of sequence: GalXC-APOC3-59-Sense
  source 1..36: mol_type = other RNA
gagcaccgttaaggacaagagcagccgaaaggctgc

SEQ ID NO: 126 - RNA, 22 nt, synthetic construct
  misc_feature 1..22: note = Description of sequence: GalXC-APOC3-59-Antisense
  source 1..22: mol_type = other RNA
tcttgtccttaacggtgctcgg

SEQ ID NO: 127 - RNA, 36 nt, synthetic construct
  misc_feature 1..36: note = Description of sequence: GalXC-APOC3-60-Sense
  source 1..36: mol_type = other RNA
agcaccgttaaggacaagtagcagccgaaaggctgc

SEQ ID NO: 128 - RNA, 22 nt, synthetic construct
  misc_feature 1..22: note = Description of sequence: GalXC-APOC3-60-Antisense
  source 1..22: mol_type = other RNA
tacttgtccttaacggtgctgg

SEQ ID NO: 129 - RNA, 36 nt, synthetic construct
  misc_feature 1..36: note = Description of sequence: GalXC-APOC3-61-Sense
  source 1..36: mol_type = other RNA
ctgtaggttgcttaaaaggagcagccgaaaggctgc

SEQ ID NO: 130 - RNA, 22 nt, synthetic construct
  misc_feature 1..22: note = Description of sequence: GalXC-APOC3-61-Antisense
  source 1..22: mol_type = other RNA
tccttttaagcaacctacaggg

SEQ ID NO: 131 - RNA, 36 nt, synthetic construct
  misc_feature 1..36: note = Description of sequence: GalXC-APOC3-62-Sense
  source 1..36: mol_type = other RNA
aggttgcttaaaagggacaagcagccgaaaggctgc

SEQ ID NO: 132 - RNA, 22 nt, synthetic construct
  misc_feature 1..22: note = Description of sequence: GalXC-APOC3-62-Antisense
  source 1..22: mol_type = other RNA
ttgtcccttttaagcaacctgg

SEQ ID NO: 133 - RNA, 36 nt, synthetic construct
  misc_feature 1..36: note = Description of sequence: GalXC-APOC3-63-Sense
  source 1..36: mol_type = other RNA
ggttgcttaaaagggacagagcagccgaaaggctgc

SEQ ID NO: 134 - RNA, 22 nt, synthetic construct
  misc_feature 1..22: note = Description of sequence: GalXC-APOC3-63-Antisense
  source 1..22: mol_type = other RNA
tctgtcccttttaagcaaccgg

SEQ ID NO: 135 - RNA, 36 nt, synthetic construct
  misc_feature 1..36: note = Description of sequence: GalXC-APOC3-64-Sense
  source 1..36: mol_type = other RNA
ccaataaagctggacaagaagcagccgaaaggctgc

SEQ ID NO: 136 - RNA, 22 nt, synthetic construct
  misc_feature 1..22: note = Description of sequence: GalXC-APOC3-64-Antisense
  source 1..22: mol_type = other RNA
ttcttgtccagctttattgggg

SEQ ID NO: 137 - RNA, 36 nt, synthetic construct
  misc_feature 1..36: note = Description of sequence: GalXC-APOC3-65-Sense
  source 1..36: mol_type = other RNA
atggcttcagttccctgaaagcagccgaaaggctgc

SEQ ID NO: 138 - RNA, 22 nt, synthetic construct
  misc_feature 1..22: note = Description of sequence: GalXC-APOC3-65-Antisense
  source 1..22: mol_type = other RNA
tttcagggaactgaagccatgg

SEQ ID NO: 139 - RNA, 36 nt, synthetic construct
  misc_feature 1..36: note = Description of sequence: GalXC-APOC3-66-Sense
  source 1..36: mol_type = other RNA
gcttcagttccctgaaagaagcagccgaaaggctgc

SEQ ID NO: 140 - RNA, 22 nt, synthetic construct
  misc_feature 1..22: note = Description of sequence: GalXC-APOC3-66-Antisense
  source 1..22: mol_type = other RNA
ttctttcagggaactgaagcgg

SEQ ID NO: 141 - RNA, 36 nt, synthetic construct
  misc_feature 1..36: note = Description of sequence: GalXC-APOC3-67-Sense
  source 1..36: mol_type = other RNA
cagttccctgaaagactacagcagccgaaaggctgc

SEQ ID NO: 142 - RNA, 22 nt, synthetic construct
  misc_feature 1..22: note = Description of sequence: GalXC-APOC3-67-Antisense
  source 1..22: mol_type = other RNA
tgtagtctttcagggaactggg

SEQ ID NO: 143 - RNA, 36 nt, synthetic construct
  misc_feature 1..36: note = Description of sequence: GalXC-APOC3-68-Sense
  source 1..36: mol_type = other RNA
agttccctgaaagactactagcagccgaaaggctgc

SEQ ID NO: 144 - RNA, 22 nt, synthetic construct
  misc_feature 1..22: note = Description of sequence: GalXC-APOC3-68-Antisense
  source 1..22: mol_type = other RNA
tagtagtctttcagggaactgg

SEQ ID NO: 145 - RNA, 36 nt, synthetic construct
  misc_feature 1..36: note = Description of sequence: GalXC-APOC3-69-Sense
  source 1..36: mol_type = other RNA
cctgaaagactactggagcagcagccgaaaggctgc

SEQ ID NO: 146 - RNA, 22 nt, synthetic construct
  misc_feature 1..22: note = Description of sequence: GalXC-APOC3-69-Antisense
  source 1..22: mol_type = other RNA
tgctccagtagtctttcagggg

SEQ ID NO: 147 - RNA, 36 nt, synthetic construct
  misc_feature 1..36: note = Description of sequence: GalXC-APOC3-70-Sense
  source 1..36: mol_type = other RNA
gaaagactactggagcaccagcagccgaaaggctgc

SEQ ID NO: 148 - RNA, 22 nt, synthetic construct
  misc_feature 1..22: note = Description of sequence: GalXC-APOC3-70-Antisense
  source 1..22: mol_type = other RNA
tggtgctccagtagtctttcgg

SEQ ID NO: 149 - RNA, 36 nt, synthetic construct
  misc_feature 1..36: note = Description of sequence: GalXC-APOC3-71-Sense
  source 1..36: mol_type = other RNA
gactactggagcaccgttaagcagccgaaaggctgc

SEQ ID NO: 150 - RNA, 22 nt, synthetic construct
  misc_feature 1..22: note = Description of sequence: GalXC-APOC3-71-Antisense
  source 1..22: mol_type = other RNA
ttaacggtgctccagtagtcgg

SEQ ID NO: 151 - RNA, 36 nt, synthetic construct
  misc_feature 1..36: note = Description of sequence: GalXC-APOC3-72-Sense
  source 1..36: mol_type = other RNA
actggagcaccgttaaggaagcagccgaaaggctgc

SEQ ID NO: 152 - RNA, 22 nt, synthetic construct
  misc_feature 1..22: note = Description of sequence: GalXC-APOC3-72-Antisense
  source 1..22: mol_type = other RNA
ttccttaacggtgctccagtgg

SEQ ID NO: 153 - RNA, 36 nt, synthetic construct
  misc_feature 1..36: note = Description of sequence: GalXC-APOC3-73-Sense
  source 1..36: mol_type = other RNA
ggagcaccgttaaggacaaagcagccgaaaggctgc

SEQ ID NO: 154 - RNA, 22 nt, synthetic construct
  misc_feature 1..22: note = Description of sequence: GalXC-APOC3-73-Antisense
  source 1..22: mol_type = other RNA
tttgtccttaacggtgctccgg

SEQ ID NO: 155 - RNA, 36 nt, synthetic construct
  misc_feature 1..36: note = Description of sequence: GalXC-APOC3-74-Sense
  source 1..36: mol_type = other RNA
gcttcatgcagggttacatagcagccgaaaggctgc

SEQ ID NO: 156 - RNA, 22 nt, synthetic construct
  misc_feature 1..22: note = Description of sequence: GalXC-APOC3-74-Antisense
  source 1..22: mol_type = other RNA
tatgtaaccctgcatgaagcgg

SEQ ID NO: 157 - RNA, 36 nt, synthetic construct
  misc_feature 1..36: note = Description of sequence: GalXC-APOC3-75-Sense
  source 1..36: mol_type = other RNA
caccgttaaggacaagttcagcagccgaaaggctgc

SEQ ID NO: 158 - RNA, 22 nt, synthetic construct
  misc_feature 1..22: note = Description of sequence: GalXC-APOC3-75-Antisense
  source 1..22: mol_type = other RNA
tgaacttgtccttaacggtggg

SEQ ID NO: 159 - RNA, 36 nt, synthetic construct
  misc_feature 1..36: note = Description of sequence: GalXC-APOC3-76-Sense
  source 1..36: mol_type = other RNA
acaagttctctgagttctgagcagccgaaaggctgc

SEQ ID NO: 160 - RNA, 22 nt, synthetic construct
  misc_feature 1..22: note = Description of sequence: GalXC-APOC3-76-Antisense
  source 1..22: mol_type = other RNA
tcagaactcagagaacttgtgg

SEQ ID NO: 161 - RNA, 36 nt, synthetic construct
  misc_feature 1..36: note = Description of sequence: GalXC-APOC3-77-Sense
  source 1..36: mol_type = other RNA
aagttctctgagttctgggagcagccgaaaggctgc

SEQ ID NO: 162 - RNA, 22 nt, synthetic construct
  misc_feature 1..22: note = Description of sequence: GalXC-APOC3-77-Antisense
  source 1..22: mol_type = other RNA
tcccagaactcagagaacttgg

SEQ ID NO: 163 - RNA, 36 nt, synthetic construct
  misc_feature 1..36: note = Description of sequence: GalXC-APOC3-78-Sense
  source 1..36: mol_type = other RNA
agttctctgagttctgggaagcagccgaaaggctgc

SEQ ID NO: 164 - RNA, 22 nt, synthetic construct
  misc_feature 1..22: note = Description of sequence: GalXC-APOC3-78-Antisense
  source 1..22: mol_type = other RNA
ttcccagaactcagagaactgg

SEQ ID NO: 165 - RNA, 36 nt, synthetic construct
  misc_feature 1..36: note = Description of sequence: GalXC-APOC3-79-Sense
  source 1..36: mol_type = other RNA
gttctctgagttctgggatagcagccgaaaggctgc

SEQ ID NO: 166 - RNA, 22 nt, synthetic construct
  misc_feature 1..22: note = Description of sequence: GalXC-APOC3-79-Antisense
  source 1..22: mol_type = other RNA
tatcccagaactcagagaacgg

SEQ ID NO: 167 - RNA, 36 nt, synthetic construct
  misc_feature 1..36: note = Description of sequence: GalXC-APOC3-80-Sense
  source 1..36: mol_type = other RNA
ggaccctgaggtcagaccaagcagccgaaaggctgc

SEQ ID NO: 168 - RNA, 22 nt, synthetic construct
  misc_feature 1..22: note = Description of sequence: GalXC-APOC3-80-Antisense
  source 1..22: mol_type = other RNA
ttggtctgacctcagggtccgg

SEQ ID NO: 169 - RNA, 36 nt, synthetic construct
  misc_feature 1..36: note = Description of sequence: GalXC-APOC3-81-Sense
  source 1..36: mol_type = other RNA
gtattctcagtgctctcctagcagccgaaaggctgc

SEQ ID NO: 170 - RNA, 22 nt, synthetic construct
  misc_feature 1..22: note = Description of sequence: GalXC-APOC3-81-Antisense
  source 1..22: mol_type = other RNA
taggagagcactgagaatacgg

SEQ ID NO: 171 - RNA, 36 nt, synthetic construct; identical to SEQ ID NO: 9
  misc_feature 1..36: note = Description of sequence: GalXC-APOC3-1-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 172 - RNA, 22 nt, synthetic construct
  misc_feature 1..22: note = Description of sequence: GalXC-APOC3-1-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tctggagcagctgcctctaggg

SEQ ID NO: 173 - RNA, 36 nt, synthetic construct; identical to SEQ ID NO: 11
  misc_feature 1..36: note = Description of sequence: GalXC-APOC3-2-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 174 - RNA, 22 nt, synthetic construct
  misc_feature 1..22: note = Description of sequence: GalXC-APOC3-2-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tggcaacaacaaggagtaccgg

SEQ ID NO: 175 - RNA, 36 nt, synthetic construct; identical to SEQ ID NO: 13
  misc_feature 1..36: note = Description of sequence: GalXC-APOC3-3-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 176 - RNA, 22 nt, synthetic construct
  misc_feature 1..22: note = Description of sequence: GalXC-APOC3-3-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tgggaggcatcctcggcctcgg

SEQ ID NO: 177 - RNA, 36 nt, synthetic construct; identical to SEQ ID NO: 15
  misc_feature 1..36: note = Description of sequence: GalXC-APOC3-4-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 178 - RNA, 22 nt, synthetic construct
  misc_feature 1..22: note = Description of sequence: GalXC-APOC3-4-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tctgcatgaagctgagaagggg

SEQ ID NO: 179 - RNA, 36 nt, synthetic construct; identical to SEQ ID NO: 17
  misc_feature 1..36: note = Description of sequence: GalXC-APOC3-5-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 180 - RNA, 22 nt, synthetic construct
  misc_feature 1..22: note = Description of sequence: GalXC-APOC3-5-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tcctgcatgaagctgagaaggg

SEQ ID NO: 181 - RNA, 36 nt, synthetic construct; identical to SEQ ID NO: 19
  misc_feature 1..36: note = Description of sequence: GalXC-APOC3-6-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 182 - RNA, 22 nt, synthetic construct
  misc_feature 1..22: note = Description of sequence: GalXC-APOC3-6-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
taaccctgcatgaagctgaggg

SEQ ID NO: 183 - RNA, 36 nt, synthetic construct; identical to SEQ ID NO: 21
  misc_feature 1..36: note = Description of sequence: GalXC-APOC3-7-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 184 - RNA, 22 nt, synthetic construct
  misc_feature 1..22: note = Description of sequence: GalXC-APOC3-7-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
ttgcacgctgctcagtgcatgg

SEQ ID NO: 185 - RNA, 36 nt, synthetic construct; identical to SEQ ID NO: 23
  misc_feature 1..36: note = Description of sequence: GalXC-APOC3-8-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 186 - RNA, 22 nt, synthetic construct
  misc_feature 1..22: note = Description of sequence: GalXC-APOC3-8-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tctgcacgctgctcagtgcagg

SEQ ID NO: 187 - RNA, 36 nt, synthetic construct; identical to SEQ ID NO: 25
  misc_feature 1..36: note = Description of sequence: GalXC-APOC3-9-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 188 - RNA, 22 nt, synthetic construct
  misc_feature 1..22: note = Description of sequence: GalXC-APOC3-9-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tactcctgcacgctgctcaggg

SEQ ID NO: 189 - RNA, 36 nt, synthetic construct; identical to SEQ ID NO: 27
  misc_feature 1..36: note = Description of sequence: GalXC-APOC3-10-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 190 - RNA, 22 nt, synthetic construct
  misc_feature 1..22: note = Description of sequence: GalXC-APOC3-10-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tgggactcctgcacgctgctgg

SEQ ID NO: 191 - RNA, 36 nt, synthetic construct; identical to SEQ ID NO: 29
  misc_feature 1..36: note = Description of sequence: GalXC-APOC3-11-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 192 - RNA, 22 nt, synthetic construct
  misc_feature 1..22: note = Description of sequence: GalXC-APOC3-11-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tgccacctgggactcctgcagg

SEQ ID NO: 193 - RNA, 36 nt, synthetic construct; identical to SEQ ID NO: 31
  misc_feature 1..36: note = Description of sequence: GalXC-APOC3-12-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 194 - RNA, 22 nt, synthetic construct
  misc_feature 1..22: note = Description of sequence: GalXC-APOC3-12-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tccatcggtcacccagccccgg

SEQ ID NO: 195 - RNA, 36 nt, synthetic construct; identical to SEQ ID NO: 33
  misc_feature 1..36: note = Description of sequence: GalXC-APOC3-13-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 196 - RNA, 22 nt, synthetic construct
  misc_feature 1..22: note = Description of sequence: GalXC-APOC3-13-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tctttcagggaactgaagccgg

SEQ ID NO: 197 - RNA, 36 nt, synthetic construct; identical to SEQ ID NO: 35
  misc_feature 1..36: note = Description of sequence: GalXC-APOC3-14-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 198 - RNA, 22 nt, synthetic construct
  misc_feature 1..22: note = Description of sequence: GalXC-APOC3-14-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tgtctttcagggaactgaaggg

SEQ ID NO: 199 - RNA, 36 nt, synthetic construct; identical to SEQ ID NO: 37
  misc_feature 1..36: note = Description of sequence: GalXC-APOC3-15-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 200 - RNA, 22 nt, synthetic construct
  misc_feature 1..22: note = Description of sequence: GalXC-APOC3-15-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tagtctttcagggaactgaagg

SEQ ID NO: 201 - RNA, 36 nt, synthetic construct; identical to SEQ ID NO: 39
  misc_feature 1..36: note = Description of sequence: GalXC-APOC3-16-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 202 - RNA, 22 nt, synthetic construct
  misc_feature 1..22: note = Description of sequence: GalXC-APOC3-16-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
taacggtgctccagtagtctgg

SEQ ID NO: 203 - RNA, 36 nt, synthetic construct; identical to SEQ ID NO: 41
  misc_feature 1..36: note = Description of sequence: GalXC-APOC3-17-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 204 - RNA, 22 nt, synthetic construct
  misc_feature 1..22: note = Description of sequence: GalXC-APOC3-17-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tccttaacggtgctccagtagg

SEQ ID NO: 205 - RNA, 36 nt, synthetic construct; identical to SEQ ID NO: 43
  misc_feature 1..36: note = Description of sequence: GalXC-APOC3-18-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 206 - RNA, 22 nt, synthetic construct
  misc_feature 1..22: note = Description of sequence: GalXC-APOC3-18-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
ttgtccttaacggtgctccagg

SEQ ID NO: 207 - RNA, 36 nt, synthetic construct; identical to SEQ ID NO: 45
  misc_feature 1..36: note = Description of sequence: GalXC-APOC3-19-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 208 - RNA, 22 nt, synthetic construct
  misc_feature 1..22: note = Description of sequence: GalXC-APOC3-19-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tagaacttgtccttaacggtgg

SEQ ID NO: 209 - RNA, 36 nt, synthetic construct; identical to SEQ ID NO: 47
  misc_feature 1..36: note = Description of sequence: GalXC-APOC3-20-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 210 - RNA, 22 nt, synthetic construct
  misc_feature 1..22: note = Description of sequence: GalXC-APOC3-20-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tgagaacttgtccttaacgggg

SEQ ID NO: 211 - RNA, 36 nt, synthetic construct; identical to SEQ ID NO: 49
  misc_feature 1..36: note = Description of sequence: GalXC-APOC3-21-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 212 - RNA, 22 nt, synthetic construct
  misc_feature 1..22: note = Description of sequence: GalXC-APOC3-21-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tagagaacttgtccttaacggg

SEQ ID NO: 213 - RNA, 36 nt, synthetic construct; identical to SEQ ID NO: 51
  misc_feature 1..36: note = Description of sequence: GalXC-APOC3-22-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 214 - RNA, 22 nt, synthetic construct
  misc_feature 1..22: note = Description of sequence: GalXC-APOC3-22-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tcagagaacttgtccttaacgg

SEQ ID NO: 215 - RNA, 36 nt, synthetic construct; identical to SEQ ID NO: 53
  misc_feature 1..36: note = Description of sequence: GalXC-APOC3-23-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 216 - RNA, 22 nt, synthetic construct
  misc_feature 1..22: note = Description of sequence: GalXC-APOC3-23-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
taactcagagaacttgtcctgg

SEQ ID NO: 217 - RNA, 36 nt, synthetic construct; identical to SEQ ID NO: 53
  misc_feature 1..36: note = Description of sequence: GalXC-APOC3-24-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 218 - RNA, 22 nt, synthetic construct
  misc_feature 1..22: note = Description of sequence: GalXC-APOC3-24-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
taactcagagaacttgtcctgg

SEQ ID NO: 219 - RNA, 36 nt, synthetic construct; identical to SEQ ID NO: 57
  misc_feature 1..36: note = Description of sequence: GalXC-APOC3-25-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 220 - RNA, 22 nt, synthetic construct
  misc_feature 1..22: note = Description of sequence: GalXC-APOC3-25-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tggtattgaggtctcaggcagg

SEQ ID NO: 221 - RNA, 36 nt, synthetic construct; identical to SEQ ID NO: 59
  misc_feature 1..36: note = Description of sequence: GalXC-APOC3-26-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 222 - RNA, 22 nt, synthetic construct
  misc_feature 1..22: note = Description of sequence: GalXC-APOC3-26-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
ttaggcaggtggacttgggggg

SEQ ID NO: 223 - RNA, 36 nt, synthetic construct; identical to SEQ ID NO: 61
  misc_feature 1..36: note = Description of sequence: GalXC-APOC3-27-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 224 - RNA, 22 nt, synthetic construct
  misc_feature 1..22: note = Description of sequence: GalXC-APOC3-27-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tataggcaggtggacttggggg

SEQ ID NO: 225 - RNA, 36 nt, synthetic construct; identical to SEQ ID NO: 63
  misc_feature 1..36: note = Description of sequence: GalXC-APOC3-28-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 226 - RNA, 22 nt, synthetic construct
  misc_feature 1..22: note = Description of sequence: GalXC-APOC3-28-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tggataggcaggtggacttggg

SEQ ID NO: 227 - RNA, 36 nt, synthetic construct; identical to SEQ ID NO: 65
  misc_feature 1..36: note = Description of sequence: GalXC-APOC3-29-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 228 - RNA, 22 nt, synthetic construct
  misc_feature 1..22: note = Description of sequence: GalXC-APOC3-29-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
ttggataggcaggtggacttgg

SEQ ID NO: 229 - RNA, 36 nt, synthetic construct; identical to SEQ ID NO: 67
  misc_feature 1..36: note = Description of sequence: GalXC-APOC3-30-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 230 - RNA, 22 nt, synthetic construct
  misc_feature 1..22: note = Description of sequence: GalXC-APOC3-30-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tatggataggcaggtggactgg

SEQ ID NO: 231 - RNA, 36 nt, synthetic construct; identical to SEQ ID NO: 69
  misc_feature 1..36: note = Description of sequence: GalXC-APOC3-31-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 232 - RNA, 22 nt, synthetic construct
  misc_feature 1..22: note = Description of sequence: GalXC-APOC3-31-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tgatggataggcaggtggacgg

SEQ ID NO: 233 - RNA, 36 nt, synthetic construct; identical to SEQ ID NO: 71
  misc_feature 1..36: note = Description of sequence: GalXC-APOC3-32-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 234 - RNA, 22 nt, synthetic construct
  misc_feature 1..22: note = Description of sequence: GalXC-APOC3-32-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tggatggataggcaggtggagg

SEQ ID NO: 235 - RNA, 36 nt, synthetic construct; identical to SEQ ID NO: 73
  misc_feature 1..36: note = Description of sequence: GalXC-APOC3-33-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 236 - RNA, 22 nt, synthetic construct
  misc_feature 1..22: note = Description of sequence: GalXC-APOC3-33-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
taggatggataggcaggtgggg

SEQ ID NO: 237 - RNA, 36 nt, synthetic construct; identical to SEQ ID NO: 75
  misc_feature 1..36: note = Description of sequence: GalXC-APOC3-34-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 238 - RNA, 22 nt, synthetic construct
  misc_feature 1..22: note = Description of sequence: GalXC-APOC3-34-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tcaggatggataggcaggtggg

SEQ ID NO: 239 - RNA, 36 nt, synthetic construct; identical to SEQ ID NO: 77
  misc_feature 1..36: note = Description of sequence: GalXC-APOC3-35-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 240 - RNA, 22 nt, synthetic construct
  misc_feature 1..22: note = Description of sequence: GalXC-APOC3-35-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tcgcaggatggataggcagggg

SEQ ID NO: 241 - RNA, 36 nt, synthetic construct; identical to SEQ ID NO: 79
  misc_feature 1..36: note = Description of sequence: GalXC-APOC3-36-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 242 - RNA, 22 nt, synthetic construct
  misc_feature 1..22: note = Description of sequence: GalXC-APOC3-36-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
taaggagctcgcaggatggagg

SEQ ID NO: 243 - RNA, 36 nt, synthetic construct; identical to SEQ ID NO: 81
  misc_feature 1..36: note = Description of sequence: GalXC-APOC3-37-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 244 - RNA, 22 nt, synthetic construct
  misc_feature 1..22: note = Description of sequence: GalXC-APOC3-37-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tccaaggagctcgcaggatggg

SEQ ID NO: 245 - RNA, 36 nt, synthetic construct; identical to SEQ ID NO: 83
  misc_feature 1..36: note = Description of sequence: GalXC-APOC3-38-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 246 - RNA, 22 nt, synthetic construct
  misc_feature 1..22: note = Description of sequence: GalXC-APOC3-38-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tcccaaggagctcgcaggatgg

SEQ ID NO: 247 - RNA, 36 nt, synthetic construct; identical to SEQ ID NO: 85
  misc_feature 1..36: note = Description of sequence: GalXC-APOC3-39-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 248 - RNA, 22 nt, synthetic construct
  misc_feature 1..22: note = Description of sequence: GalXC-APOC3-39-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tacccaaggagctcgcaggagg

SEQ ID NO: 249 - RNA, 36 nt, synthetic construct; identical to SEQ ID NO: 87
  misc_feature 1..36: note = Description of sequence: GalXC-APOC3-40-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 250 - RNA, 22 nt, synthetic construct
  misc_feature 1..22: note = Description of sequence: GalXC-APOC3-40-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tagcaacctacaggggcagcgg

SEQ ID NO: 251 - RNA, 36 nt, synthetic construct; identical to SEQ ID NO: 89
  misc_feature 1..36: note = Description of sequence: GalXC-APOC3-41-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 252 - RNA, 22 nt, synthetic construct
  misc_feature 1..22: note = Description of sequence: GalXC-APOC3-41-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
ttcccttttaagcaacctacgg

SEQ ID NO: 253 - RNA, 36 nt, synthetic construct; identical to SEQ ID NO: 91
  misc_feature 1..36: note = Description of sequence: GalXC-APOC3-42-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 254 - RNA, 22 nt, synthetic construct
  misc_feature 1..22: note = Description of sequence: GalXC-APOC3-42-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tgtcccttttaagcaacctagg

SEQ ID NO: 255 - RNA, 36 nt, synthetic construct; identical to SEQ ID NO: 93
  misc_feature 1..36: note = Description of sequence: GalXC-APOC3-43-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 256 - RNA, 22 nt, synthetic construct
  misc_feature 1..22: note = Description of sequence: GalXC-APOC3-43-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
ttactgtcccttttaagcaagg

SEQ ID NO: 257 - RNA, 36 nt, synthetic construct; identical to SEQ ID NO: 95
  misc_feature 1..36: note = Description of sequence: GalXC-APOC3-44-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 258 - RNA, 22 nt, synthetic construct
  misc_feature 1..22: note = Description of sequence: GalXC-APOC3-44-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tatactgtcccttttaagcagg

SEQ ID NO: 259 - RNA, 36 nt, synthetic construct; identical to SEQ ID NO: 97
  misc_feature 1..36: note = Description of sequence: GalXC-APOC3-45-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 260 - RNA, 22 nt, synthetic construct
  misc_feature 1..22: note = Description of sequence: GalXC-APOC3-45-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
taatactgtcccttttaagcgg

SEQ ID NO: 261 - RNA, 36 nt, synthetic construct; identical to SEQ ID NO: 99
  misc_feature 1..36: note = Description of sequence: GalXC-APOC3-46-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 262 - RNA, 22 nt, synthetic construct
  misc_feature 1..22: note = Description of sequence: GalXC-APOC3-46-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tgaatactgtcccttttaaggg

SEQ ID NO: 263 - RNA, 36 nt, synthetic construct; identical to SEQ ID NO: 101
  misc_feature 1..36: note = Description of sequence: GalXC-APOC3-47-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 264 - RNA, 22 nt, synthetic construct
  misc_feature 1..22: note = Description of sequence: GalXC-APOC3-47-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
ttgagaatactgtcccttttgg

SEQ ID NO: 265 - RNA, 36 nt, synthetic construct; identical to SEQ ID NO: 103
  misc_feature 1..36: note = Description of sequence: GalXC-APOC3-48-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 266 - RNA, 22 nt, synthetic construct
  misc_feature 1..22: note = Description of sequence: GalXC-APOC3-48-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tagcactgagaatactgtccgg

SEQ ID NO: 267 - RNA, 36 nt, synthetic construct; identical to SEQ ID NO: 105
  misc_feature 1..36: note = Description of sequence: GalXC-APOC3-49-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 268 - RNA, 22 nt, synthetic construct
  misc_feature 1..22: note = Description of sequence: GalXC-APOC3-49-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tgagcactgagaatactgtcgg

SEQ ID NO: 269 - RNA, 36 nt, synthetic construct; identical to SEQ ID NO: 107
  misc_feature 1..36: note = Description of sequence: GalXC-APOC3-50-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 270 - RNA, 22 nt, synthetic construct
  misc_feature 1..22: note = Description of sequence: GalXC-APOC3-50-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tgagagcactgagaatactggg

SEQ ID NO: 271 - RNA, 36 nt, synthetic construct; identical to SEQ ID NO: 109
  misc_feature 1..36: note = Description of sequence: GalXC-APOC3-51-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 272 - RNA, 22 nt, synthetic construct
  misc_feature 1..22: note = Description of sequence: GalXC-APOC3-51-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tagcttcttgtccagctttagg

SEQ ID NO: 273 - RNA, 36 nt, synthetic construct; identical to SEQ ID NO: 111
  misc_feature 1..36: note = Description of sequence: GalXC-APOC3-52-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'-O-methyl modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 274 - RNA, 22 nt, synthetic construct
  misc_feature 1..22: note = Description of sequence: GalXC-APOC3-52-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'- fluoro modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tcagcttcttgtccagctttgg

SEQ ID NO: 275 - RNA, 36 nt, synthetic construct; identical to SEQ ID NO: 113
  misc_feature 1..36: note = Description of sequence: GalXC-APOC3-53-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: 2'-O-methyl modified nucleotide with phosphodiester linkages
  modified_base 28: mod_base = OTHER; note = Modification: ade2'-O-methyl modified nucleotide with phosphodiester linkages -GalNAc
  modified_base 29: mod_base = OTHER; note = Modification: ade2'-O-methyl modified nucleotide with phosphodiester linkages -GalNAc
  modified_base 30: mod_base = OTHER; note = Modification: ade2'-O-methyl modified nucleotide with phosphodiester linkages -GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 276 - RNA, 22 nt, synthetic construct
  misc_feature 1..22: note = Description of sequence: GalXC-APOC3-53-Antisense
  modified_base 1: mod_base = OTHER; note = Modification: MePhosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tccagctttattagggacaggg

SEQ ID NO: 277 - RNA, 36 nt, synthetic construct; identical to SEQ ID NO: 115
  misc_feature 1..36: note = Description of sequence: GalXC-APOC3-54-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 278 - RNA, 22 nt, synthetic construct
  misc_feature 1..22: note = Description of sequence: GalXC-APOC3-54-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
ttgtaaccctgcatgaagctgg

SEQ ID NO: 279 - RNA, 36 nt, synthetic construct; identical to SEQ ID NO: 117
  misc_feature 1..36: note = Description of sequence: GalXC-APOC3-55-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 280 - RNA, 22 nt, synthetic construct
  misc_feature 1..22: note = Description of sequence: GalXC-APOC3-55-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tgtccttaacggtgctccaggg

SEQ ID NO: 281 - RNA, 36 nt, synthetic construct; identical to SEQ ID NO: 119
  misc_feature 1..36: note = Description of sequence: GalXC-APOC3-56-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 282 - RNA, 22 nt, synthetic construct
  misc_feature 1..22: note = Description of sequence: GalXC-APOC3-56-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
taacttgtccttaacggtgcgg

SEQ ID NO: 283 - RNA, 36 nt, synthetic construct; identical to SEQ ID NO: 121
  misc_feature 1..36: note = Description of sequence: GalXC-APOC3-57-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 284 - RNA, 22 nt, synthetic construct
  misc_feature 1..22: note = Description of sequence: GalXC-APOC3-57-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tcccttttaagcaacctacagg

SEQ ID NO: 285 - RNA, 36 nt, synthetic construct; identical to SEQ ID NO: 123
  misc_feature 1..36: note = Description of sequence: GalXC-APOC3-58-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 286 - RNA, 22 nt, synthetic construct
  misc_feature 1..22: note = Description of sequence: GalXC-APOC3-58-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tactgtcccttttaagcaacgg

SEQ ID NO: 287 - RNA, 36 nt, synthetic construct; identical to SEQ ID NO: 125
  misc_feature 1..36: note = Description of sequence: GalXC-APOC3-59-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 288 - RNA, 22 nt, synthetic construct
  misc_feature 1..22: note = Description of sequence: GalXC-APOC3-59-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tcttgtccttaacggtgctcgg

SEQ ID NO: 289 - RNA, 36 nt, synthetic construct; identical to SEQ ID NO: 127
  misc_feature 1..36: note = Description of sequence: GalXC-APOC3-60-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 290 - RNA, 22 nt, synthetic construct
  misc_feature 1..22: note = Description of sequence: GalXC-APOC3-60-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tacttgtccttaacggtgctgg

SEQ ID NO: 291 - RNA, 36 nt, synthetic construct; identical to SEQ ID NO: 129
  misc_feature 1..36: note = Description of sequence: GalXC-APOC3-61-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 292 - RNA, 22 nt, synthetic construct
  misc_feature 1..22: note = Description of sequence: GalXC-APOC3-61-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tccttttaagcaacctacaggg

SEQ ID NO: 293 - RNA, 36 nt, synthetic construct; identical to SEQ ID NO: 131
  misc_feature 1..36: note = Description of sequence: GalXC-APOC3-62-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 294 - RNA, 22 nt, synthetic construct
  misc_feature 1..22: note = Description of sequence: GalXC-APOC3-62-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
ttgtcccttttaagcaacctgg

SEQ ID NO: 295 - RNA, 36 nt, synthetic construct; identical to SEQ ID NO: 133
  misc_feature 1..36: note = Description of sequence: GalXC-APOC3-63-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 296 - RNA, 22 nt, synthetic construct
  misc_feature 1..22: note = Description of sequence: GalXC-APOC3-63-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tctgtcccttttaagcaaccgg

SEQ ID NO: 297 - RNA, 36 nt, synthetic construct; identical to SEQ ID NO: 135
  misc_feature 1..36: note = Description of sequence: GalXC-APOC3-64-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 298 - RNA, 22 nt, synthetic construct
  misc_feature 1..22: note = Description of sequence: GalXC-APOC3-64-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
ttcttgtccagctttattgggg

SEQ ID NO: 299 - RNA, 36 nt, synthetic construct; identical to SEQ ID NO: 137
  misc_feature 1..36: note = Description of sequence: GalXC-APOC3-65-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 300 - RNA, 22 nt, synthetic construct
  misc_feature 1..22: note = Description of sequence: GalXC-APOC3-65-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tttcagggaactgaagccatgg

SEQ ID NO: 301 - RNA, 36 nt, synthetic construct; identical to SEQ ID NO: 139
  misc_feature 1..36: note = Description of sequence: GalXC-APOC3-66-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 302 - RNA, 22 nt, synthetic construct
  misc_feature 1..22: note = Description of sequence: GalXC-APOC3-66-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
ttctttcagggaactgaagcgg

SEQ ID NO: 303 - RNA, 36 nt, synthetic construct; identical to SEQ ID NO: 141
  misc_feature 1..36: note = Description of sequence: GalXC-APOC3-67-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 304 - RNA, 22 nt, synthetic construct
  misc_feature 1..22: note = Description of sequence: GalXC-APOC3-67-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tgtagtctttcagggaactggg

SEQ ID NO: 305 - RNA, 36 nt, synthetic construct; identical to SEQ ID NO: 143
  misc_feature 1..36: note = Description of sequence: GalXC-APOC3-68-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 306 - RNA, 22 nt, synthetic construct
  misc_feature 1..22: note = Description of sequence: GalXC-APOC3-68-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tagtagtctttcagggaactgg

SEQ ID NO: 307 - RNA, 36 nt, synthetic construct; identical to SEQ ID NO: 145
  misc_feature 1..36: note = Description of sequence: GalXC-APOC3-69-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 308 - RNA, 22 nt, synthetic construct
  misc_feature 1..22: note = Description of sequence: GalXC-APOC3-69-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tgctccagtagtctttcagggg

SEQ ID NO: 309 - RNA, 36 nt, synthetic construct; identical to SEQ ID NO: 147
  misc_feature 1..36: note = Description of sequence: GalXC-APOC3-70-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 310 - RNA, 22 nt, synthetic construct
  misc_feature 1..22: note = Description of sequence: GalXC-APOC3-70-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tggtgctccagtagtctttcgg

SEQ ID NO: 311 - RNA, 36 nt, synthetic construct; identical to SEQ ID NO: 149
  misc_feature 1..36: note = Description of sequence: GalXC-APOC3-71-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 312 - RNA, 22 nt, synthetic construct
  misc_feature 1..22: note = Description of sequence: GalXC-APOC3-71-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
ttaacggtgctccagtagtcgg

SEQ ID NO: 313 - RNA, 36 nt, synthetic construct; identical to SEQ ID NO: 151
  misc_feature 1..36: note = Description of sequence: GalXC-APOC3-72-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 314 - RNA, 22 nt, synthetic construct
  misc_feature 1..22: note = Description of sequence: GalXC-APOC3-72-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
ttccttaacggtgctccagtgg

SEQ ID NO: 315 - RNA, 36 nt, synthetic construct; identical to SEQ ID NO: 153
  misc_feature 1..36: note = Description of sequence: GalXC-APOC3-73-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 316 - RNA, 22 nt, synthetic construct
  misc_feature 1..22: note = Description of sequence: GalXC-APOC3-73-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tttgtccttaacggtgctccgg

SEQ ID NO: 317 - RNA, 36 nt, synthetic construct; identical to SEQ ID NO: 155
  misc_feature 1..36: note = Description of sequence: GalXC-APOC3-74-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 318 - RNA, 22 nt, synthetic construct
  misc_feature 1..22: note = Description of sequence: GalXC-APOC3-74-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tatgtaaccctgcatgaagcgg

SEQ ID NO: 319 - RNA, 36 nt, synthetic construct; identical to SEQ ID NO: 157
  misc_feature 1..36: note = Description of sequence: GalXC-APOC3-75-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 320 - RNA, 22 nt, synthetic construct
  misc_feature 1..22: note = Description of sequence: GalXC-APOC3-75-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tgaacttgtccttaacggtggg

SEQ ID NO: 321 - RNA, 36 nt, synthetic construct; identical to SEQ ID NO: 159
  misc_feature 1..36: note = Description of sequence: GalXC-APOC3-76-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'- fluoro modified nucleotide with phosphodiester linkages
  modified_base 12: mod_base = OTHER; note = Modification: 2'-O-methyl modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'- fluoro modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 322 - RNA, 22 nt, synthetic construct
  misc_feature 1..22: note = Description of sequence: GalXC-APOC3-76-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'-O-methyl modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tcagaactcagagaacttgtgg

SEQ ID NO: 323 - RNA, 36 nt, synthetic construct; identical to SEQ ID NO: 161
  misc_feature 1..36: note = Description of sequence: GalXC-APOC3-77-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 324 - RNA, 22 nt, synthetic construct
  misc_feature 1..22: note = Description of sequence: GalXC-APOC3-77-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tcccagaactcagagaacttgg

SEQ ID NO: 325 - RNA, 36 nt, synthetic construct; identical to SEQ ID NO: 163
  misc_feature 1..36: note = Description of sequence: GalXC-APOC3-78-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 326 - RNA, 22 nt, synthetic construct
  misc_feature 1..22: note = Description of sequence: GalXC-APOC3-78-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
ttcccagaactcagagaactgg

SEQ ID NO: 327 - RNA, 36 nt, synthetic construct; identical to SEQ ID NO: 165
  misc_feature 1..36: note = Description of sequence: GalXC-APOC3-79-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 328 - RNA, 22 nt, synthetic construct
  misc_feature 1..22: note = Description of sequence: GalXC-APOC3-79-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
tatcccagaactcagagaacgg

SEQ ID NO: 329 - RNA, 36 nt, synthetic construct; identical to SEQ ID NO: 167
  misc_feature 1..36: note = Description of sequence: GalXC-APOC3-80-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 330 - RNA, 22 nt, synthetic construct
  misc_feature 1..22: note = Description of sequence: GalXC-APOC3-80-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
ttggtctgacctcagggtccgg

SEQ ID NO: 331 - RNA, 36 nt, synthetic construct; identical to SEQ ID NO: 169
  misc_feature 1..36: note = Description of sequence: GalXC-APOC3-81-Sense
  modified_base 1: mod_base = OTHER; note = Modification: 2'-O-methyl modified nucleotide with a phosphorothioate linkage
  modified_base 2: mod_base = OTHER; note = Modification: 2'-O-methyl modified nucleotide with phosphodiester linkages
  modified_base 3: mod_base = OTHER; note = Modification: 2'- fluoro modified nucleotide with phosphodiester linkages
  modified_base 4: mod_base = OTHER; note = Modification: 2'-O-methyl modified nucleotide with phosphodiester linkages
  modified_base 5: mod_base = OTHER; note = Modification: 2'-O-methyl modified nucleotide with phosphodiester linkages 2'-O-methyl modified nucleotide with phosphodiester linkages
  modified_base 7: mod_base = OTHER; note = Modification: 2'-O-methyl modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'- fluoro modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'- fluoro modified nucleotide with phosphodiester linkages
  modified_base 14: mod_base = OTHER; note = Modification: 2'-O-methyl modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'-O-methyl modified nucleotide with phosphodiester linkages
  modified_base 17: mod_base = OTHER; note = Modification: 2'- fluoro modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'-O-methyl modified nucleotide with phosphodiester linkages
  modified_base 20: mod_base = OTHER; note = Modification: 2'-O-methyl modified nucleotide with phosphodiester linkages
  modified_base 21: mod_base = OTHER; note = Modification: 2'-O-methyl modified nucleotide with phosphodiester linkages
  modified_base 22: mod_base = OTHER; note = Modification: 2'-O-methyl modified nucleotide with phosphodiester linkages
  modified_base 23: mod_base = OTHER; note = Modification: 2'-O-methyl modified nucleotide with phosphodiester linkages
  modified_base 24: mod_base = OTHER; note = Modification: 2'-O-methyl modified nucleotide with phosphodiester linkages
  modified_base 25: mod_base = OTHER; note = Modification: 2'-O-methyl modified nucleotide with phosphodiester linkages
  modified_base 26: mod_base = OTHER; note = Modification: 2'-O-methyl modified nucleotide with phosphodiester linkages
  modified_base 27: mod_base = OTHER; note = Modification: prgG-peg-GalNAc
  modified_base 28: mod_base = OTHER; note = Modification: prgA-peg-GalNAc
  modified_base 29: mod_base = OTHER; note = Modification: prgA-peg-GalNAc
  modified_base 30: mod_base = OTHER; note = Modification: prgA-peg-GalNAc
  modified_base 31: mod_base = OTHER; note = Modification: 2'-O-methyl modified nucleotide with phosphodiester linkages
  modified_base 32: mod_base = OTHER; note = Modification: 2'-O-methyl modified nucleotide with phosphodiester linkages
  modified_base 33: mod_base = OTHER; note = Modification: 2'-O-methyl modified nucleotide with phosphodiester linkages
  modified_base 34: mod_base = OTHER; note = Modification: 2'-O-methyl modified nucleotide with phosphodiester linkages
  modified_base 35: mod_base = OTHER; note = Modification: 2'-O-methyl modified nucleotide with phosphodiester linkages
  modified_base 36: mod_base = OTHER; note = Modification: 2'-O-methyl modified nucleotide with phosphodiester linkages
  source 1..36: mol_type = other RNA

SEQ ID NO: 332 - RNA, 22 nt, synthetic construct
  misc_feature 1..22: note = Description of sequence: GalXC-APOC3-81-Antisense
  modified_base 1: mod_base = OTHER; note = Modification: Phosphonate-4O-2'-O-methyl modified nucleotide with a phosphorothioate linkage
  modified_base 2: mod_base = OTHER; note = Modification: 2'- fluoro modified nucleotide with a phosphorothioate linkage
  modified_base 3: mod_base = OTHER; note = Modification: 2'- fluoro modified nucleotide with a phosphorothioate linkage
  modified_base 4: mod_base = OTHER; note = Modification: 2'-O-methyl modified nucleotide with phosphodiester linkages
  modified_base 5: mod_base = OTHER; note = Modification: 2'- fluoro modified nucleotide with phosphodiester linkages
  modified_base 6: mod_base = OTHER; note = Modification: 2'-O-methyl modified nucleotide with phosphodiester linkages
  modified_base 7: mod_base = OTHER; note = Modification: 2'- fluoro modified nucleotide with phosphodiester linkages
  modified_base 8: mod_base = OTHER; note = Modification: 2'- fluoro modified nucleotide with phosphodiester linkages
  modified_base 9: mod_base = OTHER; note = Modification: 2'-O-methyl modified nucleotide with phosphodiester linkages
  modified_base 10: mod_base = OTHER; note = Modification: 2'- fluoro modified nucleotide with phosphodiester linkages
  modified_base 11: mod_base = OTHER; note = Modification: 2'-O-methyl modified nucleotide with phosphodiester linkages
  modified_base 12: mod_base = OTHER; note = Modification: 2'- fluoro modified nucleotide with phosphodiester linkages
  modified_base 13: mod_base = OTHER; note = Modification: 2'-O-methyl modified nucleotide with phosphodiester linkages
  modified_base 14: mod_base = OTHER; note = Modification: 2'- fluoro modified nucleotide with phosphodiester linkages
  modified_base 15: mod_base = OTHER; note = Modification: 2'-O-methyl modified nucleotide with phosphodiester linkages
  modified_base 16: mod_base = OTHER; note = Modification: 2'- fluoro modified nucleotide with phosphodiester linkages
  modified_base 17: mod_base = OTHER; note = Modification: 2'-O-methyl modified nucleotide with phosphodiester linkages
  modified_base 18: mod_base = OTHER; note = Modification: 2'-O-methyl modified nucleotide with phosphodiester linkages
  modified_base 19: mod_base = OTHER; note = Modification: 2'- fluoro modified nucleotide with phosphodiester linkages
  modified_base 20: mod_base = OTHER; note = Modification: 2'-O-methyl modified nucleotide with a phosphorothioate linkage
  modified_base 21: mod_base = OTHER; note = Modification: 2'-O-methyl modified nucleotide with a phosphorothioate linkage
  modified_base 22: mod_base = OTHER; note = Modification: 2'-O-methyl modified nucleotide with phosphodiester linkages
  source 1..22: mol_type = other RNA
taggagagcactgagaatacgg

SEQ ID NO: 333 - RNA, 16 nt, synthetic construct
  misc_feature 1..16: note = Description of sequence: stem loop structure
  source 1..16: mol_type = other RNA
gcagccgaaaggctgc

SEQ ID NO: 334 - DNA, 20 bp, synthetic construct
  misc_feature 1..20: note = Description of sequence: Target Sequence 1
  source 1..20: mol_type = other DNA
ttcagttccctgaaagacta

SEQ ID NO: 335 - DNA, 20 bp, synthetic construct
  misc_feature 1..20: note = Description of sequence: Target Sequence 2
  source 1..20: mol_type = other DNA
tggagcaccgttaaggacaa

SEQ ID NO: 336 - DNA, 19 bp, synthetic construct
  misc_feature 1..19: note = Description of sequence: Target Sequence 3
  source 1..19: mol_type = other DNA
accgttaaggacaagttct

SEQ ID NO: 337 - DNA, 19 bp, synthetic construct
  misc_feature 1..19: note = Description of sequence: Target Sequence 4
  source 1..19: mol_type = other DNA
gctgcccctgtaggttgct

SEQ ID NO: 338 - DNA, 19 bp, synthetic construct
  misc_feature 1..19: note = Description of sequence: Target Sequence 5
  source 1..19: mol_type = other DNA
gtaggttgcttaaaaggga

SEQ ID NO: 339 - DNA, 19 bp, synthetic construct
  misc_feature 1..19: note = Description of sequence: Target Sequence 6
  source 1..19: mol_type = other DNA
cttaaaagggacagtattc

SEQ ID NO: 340 - DNA, 19 bp, synthetic construct
  misc_feature 1..19: note = Description of sequence: Target Sequence 7
  source 1..19: mol_type = other DNA
aaaagggacagtattctca

SEQ ID NO: 341 - DNA, 19 bp, synthetic construct
  misc_feature 1..19: note = Description of sequence: Target Sequence 8
  source 1..19: mol_type = other DNA
gacagtattctcagtgctc

The invention claimed is:

1. An RNAi oligonucleotide for reducing apolipoprotein C-III (APOC3) expression, the oligonucleotide comprising a sense strand and an antisense strand, wherein the sense strand and the antisense strand form a duplex region, wherein the sense strand is:

[mGs][mU][mA][mG][mG][mU][mU][fG][fC][fU][fU][mA][mA][mA][mA][mG][mG][mG][m A][mA][mG][mC][mA][mG][mC][mC][mG][ademA-GalNAc][ademA-GalNAc][ademA-GalNAc][mG][mG][mC][mU][mG][mC] (SEQ ID NO: 251); and the antisense strand is:

[MePhosphonate-4O-mUs][fUs][fCs][fC][fC][mU][fU][mU][mU][fA][mA][mG][mC][fA][mA][mC][mC|mU][mA][mCs][mGs][mG] (SEQ ID NO: 252), wherein:

mGs represents 2'-O-methyl guanosine with a phosphorothioate linkage to the neighboring nucleotide;

mU represents 2'-O-methyl uridine with phosphodiester linkages to neighboring nucleotides;

mA represents 2'-O-methyl adenosine with phosphodiester linkages to neighboring nucleotides;

mG represents 2'-O-methyl guanosine with phosphodiester linkages to neighboring nucleotides;

fG represents 2'-fluoro guanosine with phosphodiester linkages to neighboring nucleotides;

fC represents 2'-fluoro cytosine with phosphodiester linkages to neighboring nucleotides;

fU represents 2'-fluoro uridine with phosphodiester linkages to neighboring nucleotides;

mC represents 2'-O-methyl cytosine with phosphodiester linkages to neighboring nucleotides;

ademA-GalNAc represents 2'-aminodiethoxymethanol-Adenine-GalNAc;

MePhosphonate-4O-mUs represents 5'-methoxyphosphonate-4'-oxy uridine with a 3'-phosphorothioate linkage;

fUs represents 2'-fluoro uridine with a phosphorothioate linkage to the neighboring nucleotide;

fCs represents 2'-fluoro cytosine with a phosphorothioate linkage to the neighboring nucleotide;

fA represents 2'-fluoro adenosine with phosphodiester linkages to neighboring nucleotides; and mCs represents 2'-O-methyl cytosine with a phosphorothioate linkage to the neighboring nucleotide.

2. A pharmaceutical composition comprising:
the RNAi oligonucleotide of claim 1, or a pharmaceutically acceptable salt thereof; and
a pharmaceutically acceptable carrier, delivery agent or excipient.

3. The pharmaceutical composition of claim 2, wherein the pharmaceutically acceptable carrier is a carrier suitable for intravenous administration.

4. The pharmaceutical composition of claim 3, wherein the carrier comprises water.

5. The pharmaceutical composition of claim 3, wherein the carrier comprises phosphate buffered saline.

6. A method of reducing apolipoprotein C-III (APOC3) expression in a cell, a population of cells or an individual, the method comprising the step of:
contacting the cell or the population of cells with the RNAi oligonucleotide of claim 1; or
administering to the individual the RNAi oligonucleotide of claim 1.

7. The method of claim 6, wherein reducing APOC3 expression comprises reducing an amount or level of APOC3 mRNA, an amount or level of APOC3 protein, or both.

8. The method of claim 6, wherein the individual has a disease, disorder or condition associated with APOC3 expression.

9. A method of treating an individual having a disease, disorder or condition associated with apolipoprotein C-III (APOC3) expression, the method comprising the step of:
administering to the individual a therapeutically effective amount of the RNAi oligonucleotide of claim 1.

10. The method of claim 9, wherein the disease, disorder or condition associated with APOC3 expression is acute coronary diseases (ACD), atherosclerotic cardiovascular disease (ASCVD), alcoholic hepatitis (AH), alcoholic liver disease (ALD), cardiometabolic disease, cholangiocarcinoma (CCA), cirrhosis, coronary heart diseases (CHD), diabetes, hepatic fibrosis, hepatic inflammation, hepatocellular carcinoma (HCC), hyperlipidemia, hypertriglyceridemia, high non-HDL cholesterol, insulin resistance, liver steatosis, metabolic syndromes (MetS), non-alcoholic fatty liver disease (NAFLD), non-alcoholic steatohepatitis (NASH), obesity, or primary sclerosing cholangitis (PSC).

11. The method of claim 9, wherein the RNAi oligonucleotide is administered in combination with a second composition or therapeutic agent.

* * * * *